United States Patent 9,782,462 (MODIFIED POLYNUCLEOTIDES FOR THE PRODUCTION OF PROTEINS ASSOCIATED WITH HUMAN DISEASE) - sequence listing, part 22

SEQ ID NO: 24500 - DNA, 2051 bp, Homo sapiens
agcagcagcagcagcagctgcgagtgcgcgcgtgtgggtgtgagggtgagtgcgctggcgccggctgcagcgccctgcccagctccccgccagcttccctacccccgcctgccggagccgccctcccgtgggaccagcaccctcattccggccaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttagac

SEQ ID NO: 24501 - DNA, 3431 bp, Homo sapiens
ggccaggcaagcctgaatcctgtccctgccatctcgccactgcagctcgggtccagaaaggcaccattttgtcgcggctgcccgctctcccagggggaggagggatcttttttgcattttggagcggctgccaaggaggggaacctgttgggcatctccccagacccgcttgtgagcgcctccggggcgggcgggcgggaccagacccctcggggcacggcgtatcttggcacccggaggcagcggaggcaggcgcagcatcctcgctgggaactggagctggagtgagcgcaccgcgcgggaggagccgccgcagcctcgcagaacccgagtggaggaggtgacagctccattgccgggtttttattttttttctctccgcctccccgtctcctcctcaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttagacaaattcttcttgttttgtgaaaaaccagaactagtcagtatctcctgcccctccaccatttttttttccattttccattttcctttgaacaatttcatttaagccagagatttattgcatgaagctgagaagaggatgcagaatgacaaggaaagggcacatcaaccctgctatgctctttttttgtaagctccatagaaacagcctgagaatttggctagggaacttgaatgcttcaggggacagaaagagagcactttcgacacagtgcttcccagagtgagcttggcagggccaggcggggccaaattccatctgctgccttgttactcttgctttttgtgctcttaaatggctccatataatcttctacttacatgttccttggcttttttctcttcaaccttttccagcttatttattccattgacttctaaaggccgagtcctgggtgcttattatctggtgttctaaatgaagcagtaagttggaagcagtgccaccacccctgagtccctgagaaaggctggtctgttctttttgggtgtttctcctaagcagcaccctcccctcctcctggttttggtaaccaaaagtaacaatccatcaacctccattgtacctagaacaaaaatagccaataaaaacgctgagttgtgaagtccaatcaggcacttctaactcaccccaagctcgccatctggaaaaacagaccagaaggctctcttctacagaaatgaactgtggggaaatcaagcagctgtgacatgaagtgaatgaagtccacttgaagctgtggaagatggttcatccttttccccagttgaggatccagatttataacttctagaaagccatttccagaaggttctatgtggcacacccctaggaaaggcactaaatgcatgcaaaggatttataaacttaggaaagtagatgggtggagtccagaaaactggttctgggttaatatctctacatctgtcttgatgactcatttctcctaactcccatttagtgcagggtaaatggtttgagatgagagtttttcaatgaaagggaaattttctttcagtttacagatgtattagaagtcctgactttcaagtgtaatttgctttggaggaggaaaaa

SEQ ID NO: 24502 - DNA, 2262 bp, Homo sapiens
gcaaatcctgttcagaggagcttcagccaatgaagaggctatatcccggcttgcttgggggcttctgagtttgagctgcatgcagaaatgtaaggcagtgcttcctggcgctgatggcaaaatgggacccatctccagttattcctcgggcaccccagctttgcaaatctgggaaagaacctacataaacatattggtgatgtagccagcttaaaaggccgagagaatccttatggattcaggagactgtttttttatttagatttttattttttatttggaagatgaaatgcttctctcgttacctgccttacatcttcagacctccgaacaccatcctttcttccagctgccacacagaaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttagacaaa

SEQ ID NO: 24503 - DNA, 2088 bp, Homo sapiens
gcatgcgccccactgcagcaaagagcagccgcagcctctgcctcggccaccactgctgctgggaaagagtcgtggggctgctgacgcggttgggaggagcctcgcctttaatgcaccagccgcctccagcctcctgcagcagcagcagcagcagcagcagcagcagctgcgagtgcgcgcgtgtgggtgtgagggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttag

SEQ ID NO: 24504 - DNA, 2011 bp, Homo sapiens
agtattcccgtgaaaagggccagtcacacaggggatgactgcaagtccttcgtaaccactccaggacgctgccagggcctgagaagggacaaactccaattgctccagttcaaactggtcctggcctggtcaaacggaggagacagagcagtgattcacagcaggacgtggtacttgcagactgaccgtcctctcaggactcactagggtctcttctctgacgagatgatacctggaattgggacactcacccaggacacactatggtgcttcagccaagtgaaaggcactatcgagattggaaccacagaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctt

SEQ ID NO: 24505 - DNA, 2042 bp, Homo sapiens
gtgaagtcagtggccaccagaccctgagctccccgccccatgtgctgtggagtctaggatgttgaagagagctgggaggagatgccaagaacactaggctgcttcctaccatctagcttacagtccaacatgtgagtaacaccaatacaaatgaaaagccatcaaatgtgtccaatagtgaatatcatcccggcagtctctgagctaggagggagagtcctggagaggtgtttattttctgatataaaaaaggagccaagggagaacccaagacagagaatagtggcccaataatgaagcatgaattatccagatgaaaacacctatggaaataaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttagacaaa

SEQ ID NO: 24506 - DNA, 2745 bp, Homo sapiens
ggtggggggaggtgacttgatgtcatcctgagcagctgggcggcgggtgccggtgcgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaaagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtttgtcctgatgctcctggagctatttgatagtgaggatccccgggagcgtgagtacctcaagaccatcctgcaccgggtctatggcaagttcctgggtctccgggcctacatccgcaaacagtgcaaccacatcttcctccggttcatctatgaattcgagcacttcaatggtgtggctgagctgctggagatcctaggaagcatcatcaatggctttgcgctgcccctgaagacggagcacaagcagttcctggttcgcgtcctgatccccctgcactctgtcaagtcgctgtctgtcttccatgcccagctggcatactgtgtggtgcagttcctggagaaggatgccactctgacagagcacgtgatccgggggctgctcaaatactggccaaaaacctgcacccagaaggaggtgatgtttctgggggagatggaagagattcttgatgtcatcgagccctcccagtttgtgaagatccaggagcccctttttaagcaggtggctcgctgtgtttccagcccccatttccaggttgcagagcgggctctgtatttctggaacaatgagtatatcctaagcctcattgaggacaactgccacactgtgctgcctgctgtgtttgggaccctctaccaagtctccaaggagcactggaaccaaaccatcgtatcactgatctacaatgtgctcaagaccttcatggagatgaatgggaagctgtttgatgagctcacagcctcctacaagctggaaaagcagcaggagcagcagaaggcccaggagcgtcaggagttatggcaaggtctggaggagctgcggctacgccggctacaggggacccagggggccaaggaggcccccctccagcggcttacaccccaggtggccgccagtgggggtcagagctagacagcacctcagaaggggaaaagctaaacccagagctgtcagtccctctatcccttctcctgtccaggggcccagagagaaacacacctacccctggccttgccagagtggcttctgaggactccctgcccagcccagctttcactggggggagacgaggagaggcaatggtggtcttggcaacagaatgctcagcccctcgtggcaggacttgacaagggcaagcttgaccaggaagctgccatcagggatcttcccctgccccgcaaagctaggctccagctgcaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattc

SEQ ID NO: 24507 - DNA, 2740 bp, Homo sapiens
ggtggggggaggtgacttgatgtcatcctgagcagctgggcggcgggtgccggtgcgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaaagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtttgtcctgatgctcctggagctatttgatagtgaggatccccgggagcgtgagtacctcaagaccatcctgcaccgggtctatggcaagttcctgggtctccgggcctacatccgcaaacagtgcaaccacatcttcctccggttcatctatgaattcgagcacttcaatggtgtggctgagctgctggagatcctaggaagcatcatcaatggctttgcgctgcccctgaagacggagcacaagcctggttcgcgtcctgatccccctgcactctgtcaagtcgctgtctgtcttccatgcccagctggcatactgtgtggtgcagttcctggagaaggatgccactctgacagagcacgtgatccgggggctgctcaaatactggccaaaaacctgcacccagaaggaggtgatgtttctgggggagatggaagagattcttgatgtcatcgagccctcccagtttgtgaagatccaggagcccctttttaagcaggtggctcgctgtgtttccagcccccatttccaggttgcagagcgggctctgtatttctggaacaatgagtatatcctaagcctcattgaggacaactgccacactgtgctgcctgctgtgtttgggaccctctaccaagtctccaaggagcactggaaccaaaccatcgtatcactgatctacaatgtgctcaagaccttcatggagatgaatgggaagctgtttgatgagctcacagcctcctacaagctggaaaagcagcaggagcagcagaaggcccaggagcgtcaggagttatggcaaggtctggaggagctgcggctacgccggctacaggggacccagggggccaaggaggcccccctccagcggcttacaccccaggtggccgccagtgggggtcagagctagacagcacctcagaaggggaaaagctaaacccagagctgtcagtccctctatcccttctcctgtccaggggcccagagagaaacacacctacccctggccttgccagagtggcttctgaggactccctgcccagcccagctttcactggggggagacgaggagaggcaatggtggtcttggcaacagaatgctcagcccctcgtggcaggacttgacaagggcaagcttgaccaggaagctgccatcagggatcttcccctgccccgcaaagctaggctccagctgcaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattc

SEQ ID NO: 24508 - DNA, 887 bp, Homo sapiens
ctcagtgcgcgatcttaagcgcgcatctgtggaaacaattaaagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtt

SEQ ID NO: 24509 - DNA, 2721 bp, Homo sapiens
cgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaaatctttctgcctgacttcgttttcaaaagagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtttgtcctgatgctcctggagctatttgatagtgaggatccccgggagcgtgagtacctcaagaccatcctgcaccgggtctatggcaagttcctgggtctccgggcctacatccgcaaacagtgcaaccacatcttcctccggttcatctatgaattcgagcacttcaatggtgtggctgagctgctggagatcctaggaagcatcatcaatggctttgcgctgcccctgaagacggagcacaagcagttcctggttcgcgtcctgatccccctgcactctgtcaagtcgctgtctgtcttccatgcccagctggcatactgtgtggtgcagttcctggagaaggatgccactctgacagagcacgtgatccgggggctgctcaaatactggccaaaaacctgcacccagaaggaggtgatgtttctgggggagatggaagagattcttgatgtcatcgagccctcccagtttgtgaagatccaggagcccctttttaagcaggtggctcgctgtgtttccagcccccatttccaggttgcagagcgggctctgtatttctggaacaatgagtatatcctaagcctcattgaggacaactgccacactgtgctgcctgctgtgtttgggaccctctaccaagtctccaaggagcactggaaccaaaccatcgtatcactgatctacaatgtgctcaagaccttcatggagatgaatgggaagctgtttgatgagctcacagcctcctacaagctggaaaagcagcaggagcagcagaaggcccaggagcgtcaggagttatggcaaggtctggaggagctgcggctacgccggctacaggggacccagggggccaaggaggcccccctccagcggcttacaccccaggtggccgccagtgggggtcagagctagacagcacctcagaaggggaaaagctaaacccagagctgtcagtccctctatcccttctcctgtccaggggcccagagagaaacacacctacccctggccttgccagagtggcttctgaggactccctgcccagcccagctttcactggggggagacgaggagaggcaatggtggtcttggcaacagaatgctcagcccctcgtggcaggacttgacaagggcaagcttgaccaggaagctgccatcagggatcttcccctgccccgcaaagctaggctccagctgcaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattcaa

SEQ ID NO: 24510 - DNA, 1714 bp, Homo sapiens
agaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagaccctgtcggtgaaggtgtgggacctcaacatagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaata

SEQ ID NO: 24511 - DNA, 5133 bp, Homo sapiens
ttgacagcggacatcatttccaccgttgagtttaattactctggagatcttcttgcaacaggagacaagggcggcagagttgttatttttcagcgtgaacaagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatccaaacagaagtattgtctttttatttaattttattgcatagaatgaagttatgcagggttcttctttggaactaactgtttgagaaatgtgtgtccttctttggcagcgtgggggtatgtgtgcagcatttctgtccccaagctgctgcccgctgtgtttctgtagaagtagcccatcagatacaccaggtaaggtctgggaaaagccagaaccgaggccacctctgagaaagaaaattgcaaggaagaaccaaaattgctgccatccagtaagcctggtttaaagtagcttcaaattcactacagttgaagaaatacgtgcttgctttctaaggcttttgaaaaagcactttggggaaagtatactttttaaacattgctaaaattacatgcatgctaaatttcatcctgcatttcaagccagcaaaattaagcaattttaattacacgatgccaccagtacgttggtttattttcaaagtaggatctttgataccagaaatcaagattttccaagacaaataatacagagctgtaccaatgctgagtgaccagagcttgcttccgtgggatttaacacacgcccactacgtgtccccgaggggagtggggagtcgggctcccgtgcccctgtggagatggaggtgtgtgctgatcccccgtccgcctgtggagatgaaggtgtgtgttgattcctcctgctgctgtggagatggaggtgtgtgctgatcgcccgtcaccctgtctagatgaaggtatgtgctgattgcctgtgcccctgtggagaaggaggtgtgtgctgatcccctgtgccctgtggagatggaggtgtgtgctgctccctcgtgcccctgtggagatggaggtgtgtgctgatcccccatcccatccccctgtctagatgaaggtgtgtgctgattcctcatgcccctgtctggatgaaggtgtgtgctgatcccccgtccccctgtggagatgaaggtgtgtgctgatcccccgtgcccctgtggagatgaaggtgcgtgctgatcccccatctccctgtggagatgaaggtgtgtgctgatccccatccccctgtggagatgaagggatatgctgatcccctgtcccactgtggagatgaaggggtgtgctgatcccccgtccccctgtggagatgaaggtgtgtgctgatcccccatctccctgtggagatgaaggggtgtgccaatcccccgcgcccctgtggagatggaggcgtgtgctgatccccatccccctgtggagatgaaggtgtgtgctgatcccccatccccatgtggagatgaaggggtgtgttgatcccctgtccccctgtggagatggtgtgtgctgatccccgtccccctgtggagatgaaggtgtgtgctgatcccccatctccctgtgaagatgaaggggtgtgctgatcccccgtgcccctgtggacatggaggcgtgtgctgatcccccgtccccctgtggagatgaaggtgtgtgctgatcccccatccccatgtggagatgaaggggtgtgttgatcccccgtccccctgtggagatgaaggtgtgtgctgatccccgtccccctgtggagatgaaggggtgtgctgatcccccatgccctgtggagatggaggtgtgtgctgatccctcgtgcccctgtggagatagaggtgtgtactgatcccctgttcccctatctagatgaaggtgtgtactgctgatcccccgtccccctgtggagatgaaggtgtgtgctgatcccccatccccctgtggagatgaaggggtgtgctgatcccccgtcttcctgtggagatgaaggtgtgtgctgattcctcatgcccctgtggagatggaggtgtgtgctgatcccccatccccctgtggggatgaaggtgtgtgctgatcccccatccccctgtggagatgaaggggtatgctgatcccccgtccccctgtggagatgaaggtgtgtgctgatcccccatccccctgtggagatgaaggggtatgctgatcccctgtccccctgtggggatgaaggtgtgtgctgatctcttgtccccctgtggagatggaggtgtgtgctgatcccccatccccctgtggagatgaagatgtgtgctgatcccccgtcctcctgtggagatgaaggtgtgtgctgcttcctcgtgcccctgtggagatggaggtgtgtgctggtcccccgtccccctgtggagatggaggtgtgtgctgatcccccgtccccctgtggagatggaggcgtgtgctgatcccccatccccctgtggagatgaaggcgtgtgctgatccgccatcccactgtggagatgaaggcgtgtgctgatcccccatccccctgtggagataaaggtgtgtgctgatcccccatccccctgtggagatgaaggcgtgtgctgatccgccatcccactgtggagatgaaggcgtgtgctgatcccccatccccctgtggagatgaaggcgtgtgctcatcccccatccccctgtggagatgaaggcgtgtgctgatccgccatcccactgtggagatgaaggtgtgtgctgatcccccatccccctgtggagatgaaggtgtgtgctgatccccggtccccctgtggagatgaaggtgtgtgctgatcccccgtcctcctgtggagatgaaggcgtgtgctgatcccccgtccccctgtggagatgaaggcgtgtgctgatccgccgtccccctgtggagatgaaggcgtgtgctgatccgccatccccctgtggagatgaaggcgtgtgctcatcccccatccccctgtggagatgaaggcgtgtgctgatccgccatcccactgtggagatgaaggtgtgtgctgatcccccatccccctgtggagatgaaggcgtgtgctgatccccggtccccctgtggagatgaaggtgtgtgttgatcccccatccccctgtggaggtgaaggtgtgtgctgattactaatccacatgggcaagaacaggatgtccgtcattaccctgaatcaatgctaacacagtgccacttgagttcacattaagttagaaattgagaatctaaaggtacctttattttaactaaaaaataatttatatactgtatattgattgtgacacaatttacaaagtctgaggtgtggaacagttatttaagcattagtcaaccctggtccttaagacagttctagtaaaatgggattgtatatatttgttcaactattttgaccaaaaagttcaataaattttaaatgttt

SEQ ID NO: 24512 - DNA, 2894 bp, Homo sapiens
caccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 24513 - DNA, 1558 bp, Homo sapiens
gacgggccgggtccggacgggccgagatgccctataaactgaaaaaggagaaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccc

SEQ ID NO: 24514 - DNA, 2567 bp, Homo sapiens
caagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcaggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgag

SEQ ID NO: 24515 - DNA, 3044 bp, Homo sapiens
ggcgcctggttgtcaggcagttttgtaggagttcgggccaattggaggcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 24516 - DNA, 2893 bp, Homo sapiens
gagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcaggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctg

SEQ ID NO: 24517 - DNA, 6659 bp, Homo sapiens
ggccagaaggttcggttgcgcgtgtgccatggactcagccgcccggtgatattgacaataggagagagaaaggggcattgactgggacccaccgcgggtagcgaaaggtggctctggcagcggcggctccagctcctgcggctcctcctccttattctgtccccttctcttgctgccgctgcagatccagtcttcctccctcccttccccccctccccacgtcgtcgccgccgccgccgggtccggggcaacgagctgaggcgccgcccgccaggaatgtgagcgaggagccaccggcggagccgcaacggggtcggtgccgatttgatgggacgggcccgcgggggaggatcgtgaggccgccgccgccaccggaacgctgaggttcgggtccggccgtgaggcctagaggctccgccgccgcggaaccggagggaccccgtaccggacagccgtcgccccaggctccccgcagctgcccggacctccccctgcacgtcccggtcccgccgcccgcccccgctgcggccacctcgcccgtctcccgcccctccaagccacagatcatctttggattcttccccagaagcttcaagtagggatatgtcctcagcaccaactactcctccatcagtggataaagtagacggattttctcggaagtccgtcagaaaagccagacagaagaggtcgcaaagttcctcacagtttaggtctcaaggcaagcctattgagttaacacctctgccgctgctaaaagacgttccatcctcagagcagcctgaactgttcctaaagaaacttcagcagtgctgtgtcatttttgacttcatggacacgctatctgatcttaaaatgaaagaatacaagcgctccactcttaatgaactggtggactacattacaataagcagaggctgtttgacagagcagacttaccctgaagtagttagaatggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgtttatgaaacagaacacttcaatggtgtagctgaactgctggaaatattaggaagtattatcaatggctttgctttacctcttaaggcagaacacaaacagtttctggtgaaagtattgatccctttacacactgtcaggagcttatcactcttccatgcacagctggcatattgtatagtacagtttctggagaaagatccttcactcacagaaccagttattagggggttaatgaaattttggcctaaaacatgtagtcaaaaagaggtcatgttccttggggaactggaagaaatattggatgtgattgaaccttcacaatttgttaaaatccaagaacctttgtttaaacaaatcgccaagtgtgtatctagcccccattttcaggtggcagaaagagcactctattattggaataatgaatacatcatgagtttgatagaagaaaactctaacgtcatccttcccatcatgttttccagcctttataggatttcaaaagaacattggaatccggctattgtggcgttggtgtacaatgtgttgaaggcatttatggaaatgaacagcaccatgtttgacgagctgacagccacatacaagtcagatcgtcagcgtgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctcttttaaaaaaaaaaatcggtcttcaaagatctgttgatgaaattgctatgttaaaattccattatcgggagttccttatttatcactagcagagagtatgatacaattttcaaatgtgaacaatcttaaatttagcttgtctttctgctaagctgttaaatgtatttatagtaaaggaagaaaaaaagactgtcatttccttataagtttgtgtaacatcctcctctggataacttgactgtaatttaacatctttttcttttgcacatcttcctgagttgaatgtccacgtggaatggggtcatgaattataaaagtccctgataaaagttttgtttactggggtgaacatctttccagtaaccaggtagtcctggtactcctttagttttaaaattaggagttaagagagaagaggtgataaacatagtagggaagggaatatcggattcatgcatcagtttatggtgaatccaaatcaatgtcttgaatcctttgaaaacaggcactgggacatcacaggcttcagtacctgaccagtattagttgcatatatcattgaacacacataccagagatgttttagaaatgtgagaaaaacatccttttggaccatttgaaataagaaagacaaacactaaacaatacaaccatgaaattgatcaccgggattgcaaatctaattgggaaaagagttgagcaaacagcttggactgtttggagttgttgccttactttttaatatgtatttataaagtattccagcaaaagaggatgtagcctctgggaaaaaacaaacatgttacagtgttttttgtagattctcgttctatatctcatcacagcgccagccctgtttttagccggaaaggattcaggataaacattattatgcattctgaattggatgcatattcctaactactgtatttgttaccaaaagtggttctacaaatgctactgaaaaaaatctggaaattcctaatgtcctgagtattaataataaagtttaaaaatgcttttatatcaaaggtgcatcgtgaccaaattgtttaagaaaaaaaaacaaaaaaaacaaaatctagggctgtattttatatatatatatatatatatatatatatatatatcttattggctctctgctttgtatttaaatgaagaatcttacatcttgggtaggtaaactgctgataaaatttgtgtacagtatgtacttacctaatgcagttgcattattacgtactgaaagatatgtgtttggaggtttatttccaggatgcatttgcttgttttggtcatggcagcagtgagttggtaatcctaaaccatcacttccagcagtattcatggtatagagctgatctgtgttcatatgttgaattgtgatagtagcaaacatgaacatatgaactattgttgctcttaatagaaatacaatataaatatgggcttgtatattttcttccttacatttaaatataaagtagaatacgcagttttattattttcaagaaaaagaaagagaagctgctgacctttctcccccataaagtttttcaggatgatcaggtcacagtgtgtacgtaagagtcagctaattatggatattgtcatctcggtaactttgtaaaaaaacaaacaaaactggcattgttaattccaaaaagaaaaaaaaaagcagtaaaaaaaaaaagtcatatgcaacaccagacgcaacatggtttaatggaattaatagtttttttttttttttttttaaagaacattgatggggattcactgtaaagttggcagaggctgccaaagacgaaacaactgactttaaaaatgctggaacaatgtgataaaaaataaatttgtaacaaatcttctcctttttagcccttgtcattttagccctttagtttcaactctgcattatatttagtttatatagtgtaaacttttgtttgccattaattcatctttttaggtagaagacattaaaatcacaggtttatgaagaatctctgctcattggaatgaaatgcagtcatttgaaatgagaaaggccaggatccttttttgtaccttaccctgtcttcaagagtaaaggtgaacacttacagctctcctccttgatgtcaattttgtatgttgatcattccaaactgagaagaataaagccacattttagacatatttatagaatcaattaaagctatatgtctaaaattcgtagggcaacttctgagaagaaacaccgtctttttcttttttaatggaaagtgacaatgtgacattagtcatgttgtgtgcggtgacgcagagtaactgaggtaatctgactgttgcactatgtgacatatttcaggacgtacttgctgcatttgcagcagccctctctctctgtcccttcccacaattctgctgttgctgcaacttgagttaattgtgacaaatgcatctttgtgttatattttgtttgcttcataatttccagaactatatataaatatattttttaaatagcaaatattgtagttagtgagtgatgatcactccaaccttatccttaccatattggtttcagggataggattaagagtgtctttggaagagaaaaatacacacaaccctgtggtttagaatgacgctgaggccttaggctgtgggcctagaacaactatgtgagtgaattcacccatctcatactttgaatcaagcatgcattcctgtttctcattgtgaagtatccccagttgttttccttcagtgttgagtttttgtccttttaaattttattatattttgctctccctaacatttgactgttttttataaaagaaaagaaaaaaaaagaaataaataataccctcgatgccactggatactcacaagcagggttatgctccttcatcttgggcttgtttgcctaaatgaaagggtttaatttattttgtacctcctatgcgtgggatagtccagggtgcagagccaggacttgcttgtaattgcacctgctatacttaaatgtatagccctaggctcaatcacactatggaaagaaacaaaaaaagtatatttagagctttaaaagcttttttatttttttgtggggatgagggtgggatgggaaagggatgtatggatgttattggcatttttaagtgtttagagttttttggggtttggggtggttttttttccttgttttccttttttccttttaattggatgcactgacctggcccaggaaatgaagagattctcttttgatgctattaccaatgttatcataaagtgacagtcacctgtaacaaaaaggtggcaccagacatgatcactgatgttttatttgcacatcaatatttttatttttgtattctggctcagctgcttctctgagtggagttaaggaatgagccacaaagatttttgtagtaggtatattggcattgcattttatattcctctatatttaattttgaaaacctaaaagaaggattgtgcatcttgagagaaagttgagcaaattgtgatctagcggaatgttaatttgtgctgcttcttgtgcacgatagcagcagtagtatctctcttggaaataaacatcccatattatgatgtctatgaatataggtttccttttcttccttccctccctccttcccccacctttctcttttttttttctctctcagcttctcttttcctccttccctcttcccttcctctttctttactttttttgaaatcacttattgtaaataagttgtaatccaaacctcatgtatcaatggggaattttcaaatataaatattaccaatgcattttctggttgttgtctgatttttgattgaagtataatgagaatgacatgtctgttgcttttggtttgaggacttcgctttagcttcataaatcttttggtattttagtatttcattgttttagcaggagagggcagcaaaagttcattttccctgttagtaatgctgtggttcatgatcggttttaaatttagctgtgtgtgtgtttttttaaacagcatctctttgtgagtagaggtaaaaatgaaacatttttgatatgaaaagttgcatatgaaaattatagactggttcaaccagacagtgaagacttctgatccacatcaaacttaaaatgccacaaaacaatcttccacctctggctaaaacatgctacttccttttcaaacaccacaaaatacaagctgagtcttaaacacttggaatttaaaatgtttttctttggaaatgatttgctttcttcaaagtggtaacagaaacaaaaatgaaggtgctccccaaaaagaaatgtaaccttcccctttcacagatgtgtgagaggttctgtactgtgggtgcatcataataaagaagcagtgaagagttttcaggt

SEQ ID NO: 24518 - DNA, 1471 bp, Homo sapiens
agcatttgtgtgcatagtggctccaaagaggtgtgtgaggtgtgcgaggagggaagagcacacacttgacgttccatcctcagagcagcctgaactgttcctaaagaaacttcagcagtgctgtgtcatttttgacttcatggacacgctatctgatcttaaaatgaaagaatacaagcgctccactcttaatgaactggtggactacattacaataagcagaggctgtttgacagagcagacttaccctgaagtagttagaatggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgtttatgaaacagaacacttcaatggtgtagctgaactgctggaaatattaggaagtattatcaatggctttgctttacctcttaaggcagaacacaaacagtttctggtgaaagtattgatccctttacacactgtcaggagcttatcactcttccatgcacagctggcatattgtatagtacagtttctggagaaagatccttcactcacagaaccagttattagggggttaatgaaattttggcctaaaacatgtagtcaaaaagaggtcatgttccttggggaactggaagaaatattggatgtgattgaaccttcacaatttgttaaaatccaagaacctttgtttaaacaaatcgccaagtgtgtatctagcccccattttcaggtggcagaaagagcactctattattggaataatgaatacatcatgagtttgatagaagaaaactctaacgtcatccttcccatcatgttttccagcctttataggatttcaaaagaacattggaatccggctattgtggcgttggtgtacaatgtgttgaaggcatttatggaaatgaacagcaccatgtttgacgagctgacagccacatacaagtcagatcgtcagcgtgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaagg

SEQ ID NO: 24519 - DNA, 2164 bp, Homo sapiens
attgactgggacccaccgcgggtagcgaaaggtggctctggcagcggcggctccagctcctgcggctcctcctccttattctgtccccttctcttgctgccgctgcagatccagtcttcctccctcccttccccccctccccacgtcgtcgccgccgccgccgggtccggggcaacgagctgaggcgccgcccgccaggaatgtgagcgaggagccaccggcggagccgcaacggggtcggtgccgatttgatgggacgggcccgcgggggaggatcgtgaggccgccgccgccaccggaacgctgaggttcgggtccggccgtgaggcctagaggctccgccgccgcggaaccggagggaccccgtaccggacagccgtcgccccaggctccccgcagctgcccggacctccccctgcacgtcccggtcccgccgcccgcccccgctgcggccacctcgcccgtctcccgcccctccaagccacagatcatctttggattcttccccagaagcttcaagtagggatatgtcctcagcaccaactactcctccatcagtggataaagtagacggattttctcggaagtccgtcagaaaagccagacagaagaggtcgcaaagttcctcacagtttaggtctcaaggcaagcctattgagttaacacctctgccgctgctaaaagacgttccatcctcagagcagcctgaactgttcctaaagaaacttcagcagtgctgtgtcatttttgacttcatggacacgctatctgatcttaaaatgaaagaatacaagcgctccactcttaatgaactggtggactacattacaataagcagaggctgtttgacagagcagacttaccctgaagtagttagaatggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgtttatgaaacagaacacttcaatggtgtagctgaactgctggaaatattaggaagtattatcaatggctttgctttacctcttaaggcagaacacaaacagtttctggtgaaagtattgatccctttacacactgtcaggagcttatcactcttccatgcacagctggcatattgtatagtacagtttctggagaaagatccttcactcacagaaccagttattagggggttaatgaaattttggcctaaaacatgtagtcaaaaagaggtcatgttccttggggaactggaagaaatattggatgtgattgaaccttcacaatttgttaaaatccaagaacctttgtttaaacaaatcgccaagtgtgtatctagcccccattttcaggtggcagaaagagcactctattattggaataatgaatacatcatgagtttgatagaagaaaactctaacgtcatccttcccatcatgttttccagcctttataggatttcaaaagaacattggaatccggctattgtggcgttggtgtacaatgtgttgaaggcatttatggaaatgaacagcaccatgtttgacgagctgacagccacatacaatgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctctttt

SEQ ID NO: 24520 - DNA, 4092 bp, Homo sapiens
acatgcaaaaagtggggcctggagatggggctgtcttttttctccaaacacttgcccatccaggaaggccagccctgggcattgaagactccagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggaaaggaagcgttcaccgccacaaatcataaaatggacatgactgtggagtcttacagttcagggttctttcattcacgtcccttcctgtctcggtctgcggtctttaccacatcaataggactttttatgcgtccgggttaatttttcactccagtgcgtcctgttgcagggaccggagctgatgggagctgcttctcccccatgcctcactggtcccagatcagggctccagggacagatgatgagtctcaaacgagccagccaggggttcttttggttataaatggggcaattcgccctgtctcagagctgatgacctcaccgttgttttttggatggtgaattcatgctgagaatttgcagatgcaagctcctctcctaggtcttctgaatgtcttgaaacatcccaggtcccaggtctggtgcggtttcccgagaggagcggagtggggtttgtcttctgtgtgcctgtgtcctcatctgattcacctgccatttgctgagcctctgctgtgtaccaggcgtggtgctcagccctagaggcagttgacttaccctctgcagccctccctgccgcctcacccttcagcattcactgggcaccttcccggagcggacactgactcccatgcacgattttttggaatcttcctcctgactgtgaggtgggtgttcattcatttcctccataaacaccaacttctcgaagcgtgccaggctctgggctggatgctggggataagcgggaacccttaggatcccctctgtccacgagaagaagctgaggctctgagcggatgcacaggtcacccatggcaggtgccgtgcagtggtgtcaggaacccgtccgggtcttcacacaaggttctctccagtccatctcgtgggcggctcatgttagagcgacattcaaatggaaggtttggaaaggaatgcctctgtcttgtgaagtaggacatggcagacttggcgacgacaagggtccaggagaactgagacgcaggatggaagacagagaagaccccccggagctcctcgctctgcttggtggcttcaggagtgtggccctccccaggactccacttcatcctgggcttgcaccctccttgagccaatgcactgaactgcctttgaaaggaaattgcatgttctgaccattttaggatacctttactttaaggaccacacagtcccagaggacacatccctcgggaactctgcccctctgacaatgagggccacagagaaggtggtgtttccatggtagatgctcctgttctggtgataccaaacctgcccacccctctgagtcgtctttgctcatggacttgcagcagagccacgtagtttggcattttgattcagaaagtggggagcagagacccagccaaatccaaactttttttttggttttgttttgttttgttttttacaagatataacataacccaggaaacagacccagctgaggttattctcagtggattacagtatacttttgtgtgtgtaaaagcacaaagtgcatgtgtactcacttctggccatataacatttacacagggaaatggatcattgatttttttttaatcaacgtgaatgaagaatgtttgtttatatatcactataaaatccagttgacctggacagtattatatgtacatatctattctaattaaatttaacaatcaaaggattggattacttttttcccccttgtaaagaggttcgagaatgtggtcaattgtatagatagcgtgttaaagccaaaacccagctctgagggccttacccattacttggatatttgctacgatccatctccctttgtgagtcaaatgttaagagaagaaacttgtatttgcagctagaggttactgtcacatcatagatttaacatttaccatcttcaaagtacaaatcttacatgtccttcaaaaggaggtcttaatacagttcctagttccttacttctgttttaaactttgggtaccaaaccaaaaagaagaaaaaagaaaggaaaagatcttctttgaagaaaagtatgtctctggatccctggaaaataatgatgtccaaagcaaattgtgaagatcaaatgtgtgttaagaaaaggtgtcgaggggagggacaaaaccagaaacggtggaaggaccagtgtaatagtcacagacttgcatcctggctctgcttacatttcctggtactctcgaatgtacgggcgttcacatagtcattgtgaagttgttggggtttttttggttttgtttttaatttagctcttctctgaggacgaagctgttggtggtggtggtggtgggggtggtggtgtgggatacatggtggtcaagttgtcagccctgatcagtttggactctgtaactcataggtgcattctttttttctttggtgtctcacaaattacccaattgttgaataaaactataaatatgttaataccagctttttccaataaaataacaaatgttacatcaaaaacga

SEQ ID NO: 24521 - DNA, 1807 bp, Homo sapiens
gcggccgccgcccgcccaccgcgcgctcgcttgaccgcggcgcccgcccccggccgcccccgcccgtccccctgccgcgatgccctcccttcggggccccggcggcccgcgcccctgctaggctgcggcggcatggcccgcgcgcccggcgcgacctctgcggattgcatcggtgtgtggcggcggggcatgcccagagcaccgggcacggccttcaatgggcgaggacacggacacgcggaaaattaaccacagcttcctgcgggaccacagctatgtgactgaagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggaaaggaagcgttcaccgccaca

SEQ ID NO: 24522 - DNA, 1780 bp, Homo sapiens
gtgccagctcaatggggccgccgacctcgaagtttccgaagaagtaaaatagaaagaagaccttttttgaaatgacctgtgttagtcacctctctcaggatgcgtgaggcggacacgttgaggccacctcagctgatggaagtttccgctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggaaaggaagcgttcaccgccacaaatcataaaatggacatgactgtggagtcttacagttcagggttctttcattcacgtcccttcctgtctcggtctgcggtctttaccacatcaataggactttttatgcgtc

SEQ ID NO: 24523 - DNA, 1667 bp, Homo sapiens
atcattcaaaggattcctgcggtggtgcagagctgcggcaaagggccctcgcccgtggggttcactctcatcacccagaagcagggagaagggcctgcggctgcaggcctggctgccacaccggcctccagacaacacacagcagaagtaaaatagaaagaagaccttttttgaaatgacctgtgttagtcacctctctcaggatgcgtgaggcggacacgttgaggccacctcagctgatggaagtttccgctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacagg

SEQ ID NO: 24524 - DNA, 1832 bp, Homo sapiens
atgtgttttgggggaaacagagagaaaggtgtggcctctccacttctgtggacaccccaaataggaagaagggtgcacacaaagcaccgcttcctccacgaagccctcctcaggcacatcgaggagaaccagctgcccaagctcttggctgctgcccttctgaggcctgcctgatttgggccacatagatctggttttggccattgactggcaacatggcagtagccaactgcagagccaccagggagcagcctcattctgattgagtataacgaagacgctgatgggaaagagagacacggctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggaaaggaagcgttcaccgccacaaatcataaaa

SEQ ID NO: 24525 - DNA, 4045 bp, Homo sapiens
gctccagccatgccgaataaaaacaagaaggagaaagaatcaccaaaagcagggaagagtggaaaaagttcaaaagaaggacaagacacagtagaatcagagcaaatttccgtcaggaaaaacagccttgttgctgtcccgtctacagtatctgctaaaataaaagtaccagtctctcagcccatagtgaagaaagacaaacggcaaaattcttcaaggtttagcgcaagcaataatagagaacttcaaaaactaccatccttaaaagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttc

SEQ ID NO: 24526 - DNA, 4037 bp, Homo sapiens
ctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccagtacacagtgtatagtcaagccagcaccatgagcattccggttgcaatggagacagatgggcctttatttgaagatgtgcagatgctgagaaagacagtgaaggacgaggctcatcaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttca

SEQ ID NO: 24527 - DNA, 4304 bp, Homo sapiens
agcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccagtacacagtgtatagtcaagccagcaccatgagcattccggttgcaatggagacagatgggcctttatttgaagatgtgcagatgctgagaaagacagtgaaggacgaggctcatcaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaatataggtaagtggcacaattatttttctttagaaaatatctgtaactttatgcattagtgaaatgttaagtaccgacatattttttaacattttgtaattcaaaactttttgttttgacattgtttatgaagagaaacttcatacacttgccatttaatatgctcttttatctaattttcaaaaactctaaaaaacggtgtatcatatggactaaataaagaacatgtgaattttattgctcatcatg

SEQ ID NO: 24528 - DNA, 3845 bp, Homo sapiens
agcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcat

SEQ ID NO: 24529 - DNA, 4481 bp, Homo sapiens
gcggccgcgggggcgcgacggccggggcgggggcgctgctgctgcgggggcaggcggcggcaggggcggcggcggcggcggcggcccgctccagccatgccgaataaaaacaagaaggagaaagaatcaccaaaagcagggaagagtggaaaaagttcaaaagaaggacaagacacagtagaatcagagggaacaagtcctgaagaaccctcaagccctaaagtaccacctccacttcttcctgagttgctggttcttatttttggtgggcttcaaggaagagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccagtacacagtgtatagtcaagccagcaccatgagcattccggttgcaatggagacagatgggcctttatttgaagatgtgcagatgctgagaaagacagtgaaggacgaggctcatcaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaatataggtaagtggcacaattatttttctttagaaaatatctgtaactttatgcattagtgaaatgttaagtaccgacatattttttaacattttgtaattcaaaactttttgttttgacattgtttatgaagagaaacttcatacacttgccatttaatatgctcttttatctaattttcaaaaactctaaaaaacggtgtatcatatggactaaataaagaacatgtgaattttattgctcatcatg

SEQ ID NO: 24530 - DNA, 1526 bp, Homo sapiens
ctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatggggggggtctcgatttcactaacgttgtatatgaaaatgtctgcaataaaaagtacttttaaactttgtaa

SEQ ID NO: 24531 - DNA, 1307 bp, Homo sapiens
gccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagtaagaaagaactggctgccatctttttcagtcattttaaaatatggcacgttttactgctacttcagtaagaataaatatcagaattttaaatatcaattaaaaaacaagaaggtca

SEQ ID NO: 24532 - DNA, 2013 bp, Homo sapiens
aataaaaacaagaaggagaaagaatcaccaaaagcagggaagagtggaaaaagttcaaaagaaggacaagacacagtagaatcagagggaacaagtcctgaagaaccctcaagccctaaagtaccacctccacttcttcctgagttgctggttcttatttttggtgggcttcaaggaagagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccagtacacagtgtatagtcaagccagcaccatgagcattccggttgcaatggagacagatgggcctttatttgaagatgtgcagatgctgagaaagacagtgaaggacgaggctcatcaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggtt

SEQ ID NO: 24533 - DNA, 2824 bp, Homo sapiens
ccgcactgacatggccgtcgcccggttccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgagatgtggaatgaggttcatgaggaaaaggagcaggctgcaaagcagagtgtgtcctgcgatgaatgcataccattaccccgcgccgggcactgtgcaccttcggaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacagcccttcctggctcccccatccccctatgggctcccagccccttgcaccctcattgctgttcagattaaagcctctgttttgcacctgt

SEQ ID NO: 24534 - DNA, 2737 bp, Homo sapiens
gcactgacatggccgtcgcccggttccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggtaccatttggaactgtggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacagcccttcctggctcccccatccccctatgggctcccagccccttgcaccctcattgctgttcagattaaagcctctgttttgcacctgtca

SEQ ID NO: 24535 - DNA, 2515 bp, Homo sapiens
caccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacagcccttcctggctcccccatccccctatgggctcccagccccttgcaccctcattgctgttcagattaaagcctctgttttgcacctgtca

SEQ ID NO: 24536 - DNA, 2558 bp, Homo sapiens
ccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacagcccttcctggctcccccatccccctatgggctcccagccccttgcaccctcattgctgttcagattaaagcctctgttttgcacctgtc

SEQ ID NO: 24537 - DNA, 2664 bp, Homo sapiens
attgagacctgtggaggaggaaggaggaggtcaccgtccagctgtctctcccctgtccccacatgtcttctaagctgttggagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacagcccttcctggctcccccatccccctatgggctcccagccccttgcaccctcattgctgttcagattaaagcctctgttttgcacctgt

SEQ ID NO: 24538 - DNA, 2737 bp, Homo sapiens
atgcgccccgcgcgccccgcactgacatggccgtcgcccggttccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacagcccttcctggctcccccatccccctatgggctcccagccccttgcaccctcattgctgttcagattaaagcctctgttttgcacctgtca

SEQ ID NO: 24539 - DNA, 967 bp, Homo sapiens
gtgtgggaggctcaggagggcgagagtcatgacacggaggaactggaggggcaaaagctgaggggccccgaggagggactgagttgaatggccttaggggagagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgag

SEQ ID NO: 24540 - DNA, 1837 bp, Homo sapiens
aataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgagatgtggaatgaggttcatgaggaaaaggagcaggctgcaaagcagagtgtgtcctgcgatgaatgcataccattaccccgcgccgggcactgtgcaccttcggaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgaggccagcccctctgacacttggggcctcggaatctcccatctggggcatgggcagtcagagaagcaccagccaccccagccccgaaaagctgcagtccagctctgtcctgatgagcttggaggctgaggcaaggacctgctgcatggggagtgggggcgatgggggcctcccttctcctttatcaagtggccaaaggctcctcaaagctcgggcagtctgagtctggctctcccatggcatacctgggaagggtcttaccctttggaggcatctccaaagtgctgccttcaaatgttagtgtgtatgatcactgagtggtgggaggtctgagggtaggccgagaattggcatttttatggaccgcttcagggattttgatgcaaatggttttccctgctctcaaatcagatgctgaggagaggagagctgaggcttcctggagctccccctgctggcaggcagccgagggtgtctcctgccctcttggcactgttctcccagccaaggaggtggccttttctctcttccaagtggggaggagacattttatttctactctgtcccttctgctagctcctcccacttcctgggaagactaattctagaactgcttgaccttggccag

SEQ ID NO: 24541 - DNA, 1204 bp, Homo sapiens
tttgggtctaggctcttgggcatggtgttcaacagtagaccctaggaggagtgtgcccaggagccggggtggctgcagcaagggcccatcttgccacgtggccgctggttgcagcacacgttgtgttggttctccagagcgcccaccctcttccacctcggagcagtgagcagcattttgcagtccctagttgatgaagactggcccatttgcagagcactccaaccagctgtggaacatcagcgccgtcccttcctggtccaaagtgaaccagggtctcatccgcatgtataaggccgaggtgagtgggggctggccagtgtgcccgtccctgctgccgcacttggtcctgggctggggacaaagcaaaagatgtggaacctggggctcctgcttcctcctaccccactgttttgctctgaatcttaggccagcccctctgacacttggggcctcggaatctcccatctggggcatgggcagtcagagaagcaccagccaccccagccccgaaaagctgcagtccagctctgtcctgatgagcttggaggctgaggcaaggacctgctgcatggggagtgggggcgatgggggcctcccttctcctttatcaagtggccaaaggctcctcaaagctcgggcagtctgagtctggctctcccatggcatacctgggaagggtcttaccctttggaggcatctccaaagtgctgccttcaaatgttagtgtgtatgatcactgagtggtgggaggtctgagggtaggccgagaattggcatttttatggaccgcttcagggattttgatgcaaatggttttccctgctctcaaatcagatgctgaggagaggagagctgaggcttcctggagctccccctgctggcaggcagccgagggtgtctcctgccctcttggcactgttctcccagccaaggaggtggccttttctctcttccaagtggggaggagacattttatttctactctgtcccttctgctagctcctcccacttcctgggaagactaattctagaactgcttgaccttggccagggaagggctggatgtgaagttccacacctggagtgatgggtccttaaagtcccttctttctgttctcaggctggcccttgtgactagttcatggcctcagacactgtactgtgggcaccatctcttgactcctggccggccttctcttct

SEQ ID NO: 24542 - DNA, 3885 bp, Homo sapiens
gcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaatgatttaaagtggggaaactagattaaaatatttgtcttttaactagtt

SEQ ID NO: 24543 - DNA, 1407 bp, Homo sapiens
cggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggtt

SEQ ID NO: 24544 - DNA, 1866 bp, Homo sapiens
ggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtataaaaagagaagtgatttgcaagatgaactggatataaatgagctaccaaattgtaaaataaatcaagaagattctgtgcctttaatcagcgatgctgttgagaggtgctttgtttctgatcggaccatttcactgcagcaagcaacacagtattctgagcagaagatcgggacttgaggccatgttgcggagggccagtgacattatctggactctggagtgtgaggaatatggactccactcttcactatattcacagcgattcagacttgagcaacaatagcagttttagccctgatgaggaaaggagaactaaagtacaagatgttgtacctcaggcgttgttagatcagtatttat

SEQ ID NO: 24545 - DNA, 3925 bp, Homo sapiens
ccggctccccggctcgcgccgctccatgtagccccggctccccgggcggccgcggaggagggggcgaccacaagatggcggacctctcgctgcttcaggaggacctgcaggaggacgcagacggatttggtgtggatgactacagctcagagtctgatgtgattattataccttcagccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaatgatttaaagtggggaaactagattaaaatatttgtcttttaactagtt

SEQ ID NO: 24546 - DNA, 2869 bp, Homo sapiens
ggcttggggaggtgctcgctctgtcggtcttgctctctcgcacgcttcccccggctcccttcgtttcccccccccggtcgcctgcgtgccggagtgtgtgcgagggagggggagggcgtcgggggggtggggggaggcgttccggtccccaagagacccgcggagggaggcggaggctgtgagggactccgggaagccatggacgtcgagaggctccaggaggcgctgaaagattttgagaagagggggaaaaaggaagtttgtcctgtcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagaggagtagaaaagaatgtgatggttgttagctgtgtttatccttcttcagagaaaaacaattccaatagtttaaatcgaatgaatggtgttatgtttcctggaaattcaccaagctatactgagaggtctaatataaatgggcctgggacacccaggccacttaatcgaccaaaggtttctttgtcagcccccatgacaacaaatgggttgcctgagagcacagacagcaaagaggcaaatttgcagcaaaatgaggagaaaaatcacagtgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcaggataaagacaaagatagccgttgtacccggcagcactgtacagaagaggatgaagaagaggatgaagaggaagaagaagagtcttttatgacatcaagagaaatgatcccagaaagaaaaaatcaagaaaaagaatctgatgatgccttaactgtgaatgaagagacttctgaggaaaataatcaaatggaggaatctgatgtgtctcaagctgagaaagatttgctacattctgaaggtagtgaaaacgaaggccctgtaagtagtagttcttctgactgccgtgaaacagaagaattagtaggatccaattccagtaaaactggagagattctttcagaatcatccatggaaaatgatgacgaagccacagaagtcaccgatgaaccaatggaacaagactaactatttagaaacatttagatgcagtattttacatacagttctggttttaacactgtataaaacttttgtgtaataaaatggacctttagttttacaagagaagcaggttgtaaaataaagtactttatggataattcctgaaagagttgtacatgtaagaactgtgaatatcagctcctctgggtcctgcttaccttaccgctgacttttctttctttctttttttggtctgggcaaatcagtggtttgtgtatagatttttttttttttttaatttaggattgaagtttttaaactggaaagtaattacaattttgaaaagttttttgagattatcacatttagtttatacatatgcaagaagctttttgtcttgtctctttctgatagctctagcagttttcatattttggtcatagtttcaacattttaacatgtgaattatagggtttcatgctggtttccagattttattgtttggctacgtacaatggaactttaagtcatatatacatacatatatatatatatatatatataattctaaggggggaaatgttatatttttctgtttctataagagatgaatacagtggatactttttctattggtaatgattgagttcacctctttcagaagacattttctttctcttctgagtaattgaaataaaatctggcccttgtgaaaccctggaaatcttaagtctgttgaaataccaggttaaacacattccaagagatctgttcaaactcaaattcttttgtatacttctgaggtgcctgagaaaaagacttcattatttatgagaaaatatgctttatcttggaaattgtgttcaaatgttagcttactattttgtagaatgaatgtttatgaagctgatatgagaccatctcagaagaaccaagtaggttccttgaccttttgcttgcttttctgaacattgtgaatattacacatgtctttctaaattattctagggtatgcaaatgtcaatggtatgaaacaccactgtactggaagaattaatatattactttagtatgtacctgagctaaatgactgaagctttaggggtgcatagaaaccaccataatttgtatgacattttgaagtgaattaaatatttttgaacatgcttcttcgacagccagtgttatatttttcagatcaacacaaagcacaatgattactcgaaattcagtattttcaaatttacatatttaaagtcatgcaagctgtaacttccctgtcaaaattactggctgccaaatttatacctgtttcttcagctgtaccttttgatatttaaagtttttaaatttctgtaaagtagattttgtagaatgtaatgtgttcactgcctttgtgaagcggtatataattgtataatttctgtgtgtaaactgaatg

SEQ ID NO: 24547 - DNA, 4984 bp, Homo sapiens
agggagcgtgcgcgcggtgacgtaccgggcgccatgttggagggttggtggtagcggcttggggaggtgctcgctctgtcggtcttgctctctcgcacgcttcccccggctcccttcgtttcccccccccggtcgcctgcgtgccggagtgtgtgcgagggagggggagggcgtcgggggggtggggggaggcgttccggtccccaagagacccgcggagggaggcggaggctgtgagggactccgggaagccatggacgtcgagaggctccaggaggcgctgaaagattttgagaagagggggaaaaaggaagtttgtcctgtcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagaggagtagaaaagaatgtgatggttgttagctgtgtttatccttcttcagagaaaaacaattccaatagtttaaatcgaatgaatggtgttatgtttcctggaaattcaccaagctatactgagaggtctaatataaatgggcctgggacacccaggccacttaatcgaccaaaggtttctttgtcagcccccatgacaacaaatgggttgcctgagagcacagacagcaaagaggcaaatttgcagcaaaatgaggagaaaaatcacagtgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcaggataaagacaaagatagccgttgtacccggcagcactgtacagaagaggatgaagaagaggatgaagaggaagaagaagagtcttttatgacatcaagagaaatgatcccagaaagaaaaaatcaagaaaaagaatctgatgatgccttaactgtgaatgaagagacttctgaggaaaataatcaaatggaggaatctgatgtgtctcaagctgagaaagatttgctacattctgaaggtagtgaaaacgaaggccctgtaagtagtagttcttctgactgccgtgaaacagaagaattagtaggatccaattccagtaaaactggagagattctttcagaatcatccatggaaaatgatgacgaagccacagaagtcaccgatgaaccaatggaacaagactaactatttagaaacatttagatgcagtattttacatacagttctggttttaacactgtataaaacttttgtgtaataaaatggacctttagttttacaagagaagcaggttgtaaaataaagtactttatggataattcctgaaagagttgtacatgtaagaactgtgaatatcagctcctctgggtcctgcttaccttaccgctgacttttctttctttctttttttggtctgggcaaatcagtggtttgtgtatagatttttttttttttttaatttaggattgaagtttttaaactggaaagtaattacaattttgaaaagttttttgagattatcacatttagtttatacatatgcaagaagctttttgtcttgtctctttctgatagctctagcagttttcatattttggtcatagtttcaacattttaacatgtgaattatagggtttcatgctggtttccagattttattgtttggctacgtacaatggaactttaagtcatatatacatacatatatatatatatatatatataattctaaggggggaaatgttatatttttctgtttctataagagatgaatacagtggatactttttctattggtaatgattgagttcacctctttcagaagacattttctttctcttctgagtaattgaaataaaatctggcccttgtgaaaccctggaaatcttaagtctgttgaaataccaggttaaacacattccaagagatctgttcaaactcaaattcttttgtatacttctgaggtgcctgagaaaaagacttcattatttatgagaaaatatgctttatcttggaaattgtgttcaaatgttagcttactattttgtagaatgaatgtttatgaagctgatatgagaccatctcagaagaaccaagtaggttccttgaccttttgcttgcttttctgaacattgtgaatattacacatgtctttctaaattattctagggtatgcaaatgtcaatggtatgaaacaccactgtactggaagaattaatatattactttagtatgtacctgagctaaatgactgaagctttaggggtgcatagaaaccaccataatttgtatgacattttgaagtgaattaaatatttttgaacatgcttcttcgacagccagtgttatatttttcagatcaacacaaagcacaatgattactcgaaattcagtattttcaaatttacatatttaaagtcatgcaagctgtaacttccctgtcaaaattactggctgccaaatttatacctgtttcttcagctgtaccttttgatatttaaagtttttaaatttctgtaaagtagattttgtagaatgtaatgtgttcactgcctttgtgaagcggtatataattgtataatttctgtgtgtaaactgaatgcttgggctttcaatacagtattcatataaagcaataaatattaatgttatgaaatatttgactacatttttatcaaaatatgaaagaatccccccttttttagtttcagatacctgaactacacagatgagcttctaaaactgatgcaaacagtttctgacactgtataatatgcttttgggtgatttggggggcaaccacaagttttgcgttttgactacttaaatcatcatggctataaataccaaaacgatttggatccatttatgtttgtaggataatatactactgactgacttgactgtcaggttcacaacagctagatgatatatttatgactatgtctaatagttgaaataaaatctgaatattgatttactatacccaagaggggagaaaaattaaccattgtaaatttttaaaaaatttttcaaaaatgttaaaatgaggcaaatttaagtttacaaattttgaaattttcttttgaatatttatgaaattgtcagtaaacttacctaagatcctgtgaccttttgatattttttattttaattgtagtgccatggaccatttgtaaacaaattgatttacttttgttggttgtaagttgaagatttagcattatgactttgaggtctgtggttttatttgtaaacttgcaattgctatatttgcaagggcaaatgtatttctttattaaataaagtacaataatggtgaatgtaccaaaatgacatcacttaactctatgagagatctgcattttaatctatagtttaatagttttaatatttattagatattcatatgttgatcatagatcaaacttgttgctgtttatacagataattgtagaatgctcatggaatatctttagggtaggtggaatacttctgtagttaaattgggaaaccttgttcagctggttttagatattgatggccatttggaagtaaatttccgcaggtattcataggtgcacttaacacagactttgcttaatgaaaatgtcagttctaatagtaactgattcacttctgaacagaagtgattttaggcatatttcttaacatatatcaagcaaagtcctgttaaaagatctaaatgaagaatggagacctcagtgattaaagatattttgtttctgaccttgagcagattgcttacctgttctctagactataacccaacatgtaaaaaaaatttgaagatggtgatgaggaaagtgagatatatatatatatatgtattatgtttctagcacttttcccttttaaaaagtgaaaatatccttgtacatttttgaaaaatatattttcagttctgaaaaatgtagcagaagtagtgaaaatgtcatattttaaatgttgattattagataaatttaacctgcttagggtttattgtaactacacctttcagacgtgtgttttggagtagtggaattgccagccaggccctgtggcttggaaaggcatcccagaaatcctcggccagaaggtgtggcttgttaaagcattgagattcagagtattttgttttgccggtgtagataggcatgtatttatgcatttttgcatttgtaaaatcaacttttcaaataatgtaaatgtaatatactagtttacttaaaggtacttgggcagaatctaaagctgctacaatgtttgattatgaaaaaaatgtaacatggtaaggatgaaaatgcaacttacaaaaccaaaggaattaaaaattttcggtagtgtttcaaattgtcttctgaacaggaatttaacattggttttgatgaaggtgagggtcagttctcaagatttgtgctaatcataaaatgaatgaatgcaaaacaccttgtaatttcatatggaattataaaaattaggtttgctgggttttggcctaataagagtgctagtatgtattggttagactacatcttactatttcacattttaaaaatcagtacactcttcaggattttcttttatttcaacttggagcctagattactttgccaaatgtattattttcataatgcaataaaatataaattagaatat

SEQ ID NO: 24548 - DNA, 2698 bp, Homo sapiens
ggcttggggaggtgctcgctctgtcggtcttgctctctcgcacgcttcccccggctcccttcgtttcccccccccggtcgcctgcgtgccggagtgtgtgcgagggagggggagggcgtcgggggggtggggggaggcgttccggtccccaagagacccgcggagggaggcggaggctgtgagggactccgggaagccatggacgtcgagaggctccaggaggcgctgaaagattttgagaagagggggaaaaaggaagtttgtcctgtcctggatcagtttctttgtcatgtagccaagactggagaaacaattatcccttttactattcagcgactatgtgaattgttaacagatccaaggagaaactatacaggaacagacaaatttctcagaggagtagaaaagaatgtgatggttgttagctgtgtttatccttcttcagagaaaaacaattccaatagtttaaatcgaatgaatggtgttatgtttcctggaaattcaccaagctatactgagaggtctaatataaatgggcctgggacacccaggccacttaatcgaccaaaggtttctttgtcagcccccatgacaacaaatgggttgcctgagagcacagacagcaaagaggcaaatttgcagcaaaatgaggagaaaaatcacagtgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcaggataaagacaaagatagccgttgtacccggcagcactgtacagaagaggatgaagaagaggatgaagaggaagaagaagagtcttttatgacatcaagagaaatgatcccagaaagaaaaaatcaagaaaaagaatctgatgatgccttaactgtgaatgaagagacttctgaggaaaataatcaaatggaggaatctgatgtgtctcaagctgagaaagatttgctacattctgaaggtagtgaaaacgaaggccctgtaagtagtagttcttctgactgccgtgaaacagaagaattagtaggatccaattccagtaaaactggagagattctttcagaatcatccatggaaaatgatgacgaagccacagaagtcaccgatgaaccaatggaacaagactaactatttagaaacatttagatgcagtattttacatacagttctggttttaacactgtataaaacttttgtgtaataaaatggacctttagttttacaagagaagcaggttgtaaaataaagtactttatggataattcctgaaagagttgtacatgtaagaactgtgaatatcagctcctctgggtcctgcttaccttaccgctgacttttctttctttctttttttggtctgggcaaatcagtggtttgtgtatagatttttttttttttttaatttaggattgaagtttttaaactggaaagtaattacaattttgaaaagttttttgagattatcacatttagtttatacatatgcaagaagctttttgtcttgtctctttctgatagctctagcagttttcatattttggtcatagtttcaacattttaacatgtgaattatagggtttcatgctggtttccagattttattgtttggctacgtacaatggaactttaagtcatatatacatacatatatatatatatatatatataattctaaggggggaaatgttatatttttctgtttctataagagatgaatacagtggatactttttctattggtaatgattgagttcacctctttcagaagacattttctttctcttctgagtaattgaaataaaatctggcccttgtgaaaccctggaaatcttaagtctgttgaaataccaggttaaacacattccaagagatctgttcaaactcaaattcttttgtatacttctgaggtgcctgagaaaaagacttcattatttatgagaaaatatgctttatcttggaaattgtgttcaaatgttagcttactattttgtagaatgaatgtttatgaagctgatatgagaccatctcagaagaaccaagtaggttccttgaccttttgcttgcttttctgaacattgtgaatattacacatgtctttctaaattattctagggtatgcaaatgtcaatggtatgaaacaccactgtactggaagaattaatatattactttagtatgtacctgagctaaatgactgaagctttaggggtgcatagaaaccaccataatttgtatgacattttgaagtgaattaaatatttttgaacatgcttcttcgacagccagtgttatatttttcagatcaacacaaagcacaatgattactcgaaattcagtattttcaaatttacatatttaaagtcatgcaagctgtaacttccctgtcaaaattactggctgccaaatttatacctgtttcttcagctgtaccttttgatatttaaagtttttaaatttctgtaaagtagattttgtagaatgtaatgtgttcactgcctttgtgaagcggtatataattgtataatttctgtgtgtaaactgaatg

SEQ ID NO: 24549 - DNA, 1929 bp, Homo sapiens
ggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtca

SEQ ID NO: 24550 - DNA, 2109 bp, Homo sapiens
acgacacttgtgcggcagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtca

SEQ ID NO: 24551 - DNA, 1961 bp, Homo sapiens
atggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcgg

SEQ ID NO: 24552 - DNA, 1886 bp, Homo sapiens
cgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgggtaggcccagcagtggttcttgacatcacacgatgaggcgcgcatctcccgtcatccagggagaccagaggacccttgtctcactcccagttggctcttagtcacagccccgctttgtctttgacatggacgtttgtgatgatcacgttcctcccgctccccgtgtctgaagagtgctccctgactggctgccgtctcctccctgtcgggtctggctgggttctccagagggagtgctgcggaggggacacagcagaggccccatgctcgtgatgtatgttgcagatcattttcccccattctgtccttttttgttaaattgtggtaaaaagcacataacataaactgtaccaccttaaccatttgaaagtatatatcccagactgtcttttatctttagacttcacttgtggtttgttgccacagtacaagtttatttttatgaagccaaa

SEQ ID NO: 24553 - DNA, 960 bp, Homo sapiens
ttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagc

SEQ ID NO: 24554 - DNA, 4118 bp, Homo sapiens
ggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttatttttgaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatcctaaaacacctggatcaacagtacatctcatatgcaatctgcatcagctcctattctgtctggatgtctagaactgttggaagattttgacgtcttaagccctaggttttgctttgggaaataaggtttgaaatattgttcattgcattaagatttgtgtgtgtgtgctttgtaagcccagaaccaggttttggaaaatgcctgtactgtgaaagcaaattaggactctttctgagcctctttcattgtcagaaatagaatcactttccatcagcttccaggaaattgtgtatctggagtcgaagagatttgacatcaagaatccagatttttaaatgtaattgttttttaaatgctaatgtttgtaaagcaccttcagttcttcggatgaaaggtgctatattccctcagtgtaaattaataaaaagattacaggaagtttgtcaaaaaattcaatgcatagtctgtagtatgtcctgacaagaagttagcattttatataagaaattaaaaaatgcttattcctcca

SEQ ID NO: 24555 - DNA, 4172 bp, Homo sapiens
gaagcgggctctcttggggcctgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttatttttgaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatcctaaaacacctggatcaacagtacatctcatatgcaatctgcatcagctcctattctgtctggatgtctagaactgttggaagattttgacgtcttaagccctaggttttgctttgggaaataaggtttgaaatattgttcattgcattaagatttgtgtgtgtgtgctttgtaagcccagaaccaggttttggaaaatgcctgtactgtgaaagcaaattaggactctttctgagcctctttcattgtcagaaatagaatcactttccatcagcttccaggaaattgtgtatctggagtcgaagagatttgacatcaagaatccagatttttaaatgtaattgttttttaaatgctaatgtttgtaaagcaccttcagttcttcggatgaaaggtgctatattccctcagtgtaaattaataaaaagattacaggaagtttgtcaaaaaattcaatgcatagtctgtagtatgtcctgacaagaagttagcattttatataagaaattaaaaaatgcttattcctcc

SEQ ID NO: 24556 - DNA, 4349 bp, Homo sapiens
gaagcgggctctcttggggcctgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaaggtgagccctatttgcgggctcgccccttccggctgtggggcgcccgccggccggcccttcctttctccaggacccccgccggtatttcattttcttcgttttctaaaggagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttatttttgaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatcctaaaacacctggatcaacagtacatctcatatgcaatctgcatcagctcctattctgtctggatgtctagaactgttggaagattttgacgtcttaagccctaggttttgctttgggaaataaggtttgaaatattgttcattgcattaagatttgtgtgtgtgtgctttgtaagcccagaaccaggttttggaaaatgcctgtactgtgaaagcaaattaggactctttctgagcctctttcattgtcagaaatagaatcactttccatcagcttccaggaaattgtgtatctggagtcgaagagatttgacatcaagaatccagatttttaaatgtaattgttttttaaatgctaatgtttgtaaagcaccttcagttcttcggatgaaaggtgctatattccctcagtgtaaattaataaaaagattacaggaagtttgtcaaaaaattcaatgcatagtctgtagtatgtcctgacaagaagttagcattttatataagaaattaaaaaatgcttattcctcc

SEQ ID NO: 24557 - DNA, 569 bp, Homo sapiens
cgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagttttgggctatgatgcattaggcttctgcgagtatttatatacagattttgaacatgtttttattgccaagactacagttgctgggtcaaatgcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaat

SEQ ID NO: 24558 - DNA, 2677 bp, Homo sapiens
attgcgcagggtgcattgccctgaagagcgctcctccttccggtgaaagtcgtcgggttcccagccgggagtctgcggagttctcatactctgttacccagcttcctttgtatgagtgctgttgcgcacttccggtggaagcgctgaagcgagtgggtggagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacggcagcgattattagtagagttcagtgtaggattgtagctttggatctgcgaagtcatggtgaaacaaaggtcaagaatcctgaagatctgtctgcagaaacaatggcaaaagacgttggcaatgtggttgaagccatgtatggggaccttcctcctccaattatgctgattggacatagcatgggtggtgctattgcagtccacacagcatcatccaacctggtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagtgtgaaggaattacaagtccagaaggctcaaaatctatagtggaaggaatcatagaggaagaagaagaagatgaggaaggaagtgagtctataagcaagaggaaaaaggaagatgacatggagaccaagaaagaccatccatacacctggagaattgaactggcaaaaacagaaaaatactgggacggctggttccgaggcttatccaatctctttcttagttgtcccattcctaaattgctgctcttggctggtgttgatagattggataaagatctgaccattggccagatgcaagggaagttccagatgcaggtcctaccccagtgtggccatgcagtccatgaggatgcccctgacaaggtagctgaagctgttgccactttcctgatccggcacaggtttgcagaacccatcggtggattccagtgtgtgtttcctggctgttagtgacctgctgtccacccctcctcaacatcgagctctgttgtaaatacgtcgcaccagaggccactgtgatgccactgtctcctctccatcccgcccagccatgtgacactggctcccggtagacgggcaccccgagatgtaccaaccttttcatgtattctgccaaaagcattgttttccagggcccttgaccaacatcggcttccccagtccagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaaccttta

SEQ ID NO: 24559 - DNA, 1928 bp, Homo sapiens
ctttatttctctgcgagcatcactaaattctgctgtcatcaagagcagatatatagtagttgactcagtaagtgtaaatgctcagaataagttaaatatgtggttacagtttttgtttaacatccaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagtgtgaaggaattacaagtccagaaggctcaaaatctatagtggaaggaatcatagaggaagaagaagaagatgaggaaggaagtgagtctataagcaagaggaaaaaggaagatgacatggagaccaagaaagaccatccatacacctggagaattgaactggcaaaaacagaaaaatactgggacggctggttccgaggcttatccaatctctttcttagttgtcccattcctaaattgctgctcttggctggtgttgatagattggataaagatctgaccattggccagatgcaagggaagttccagatgcaggtcctaccccagtgtggccatgcagtccatgaggatgcccctgacaaggtagctgaagctgttgccactttcctgatccggcacaggtttgcagaacccatcggtggattccagtgtgtgtttcctggctgttagtgacctgctgtccacccctcctcaacatcgagctctgttgtaaatacgtcgcaccagaggccactgtgatgccactgtctcctctccatcccgcccagccatgtgacactggctcccggtagacgggcaccccgagatgtaccaaccttttcatgtattctgccaaaagcattgttttccagggcccttgaccaacatcggcttccccagtccagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaaccttta

SEQ ID NO: 24560 - DNA, 2496 bp, Homo sapiens
agggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacggcagcgattattagtagagttcagtgtaggattgtagctttggatctgcgaagtcatggtgaaacaaaggtcaagaatcctgaagatctgtctgcagaaacaatggcaaaagacgttggcaatgtggttgaagccatgtatggggaccttcctcctccaattatgctgattggacatagcatgggtggtgctattgcagtccacacagcatcatccaacctggtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagtgtgaaggaattacaagtccagaaggctcaaaatctatagtggaaggaatcatagaggaagaagaagaagatgaggaaggaagtgagtctataagcaagaggaaaaaggaagatgacatggaggggttgccctcggagactcagaacttgctcttattcctccagaccaagaaagaccatccatacacctggagaattgaactggcaaaaacagaaaaatactgggacggctggttccgaggcttatccaatctctttcttagttgtcccattcctaaattgctgctcttggctggtgttgatagattggataaagatctgaccattggccagatgcaagggaagttccagatgcaggtcctaccccagtgtggccatgcagtccatgaggatgcccctgacaaggtagctgaagctgttgccactttcctgatccggcacaggtttgcagaacccatcggtggattccagtgtgtgtttcctggctgttagtgacctgctgtccacccctcctcaacatcgagctctgttgtaaatacgtcgcaccagaggccactgtgatgccactgtctcctctccatcccgcccagccatgtgacactggctcccggtagacgggcaccccgagatgtaccaaccttttcatgtattctgccaaaagcattgttttccagggcccttgaccaacatcggcttccccagtccagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaaccttta

SEQ ID NO: 24561 - DNA, 2690 bp, Homo sapiens
gaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggctgggagaacacatccctggtcagctgtaggaaagccagagagcatttgagaagaggctgaagcttgaattttgcaaacacacaagccctctgcatttccccagagagaaggtttttttctcgtcttcatttcctttgaaacacctggggtgaggaaaaacctctacattggccaagcagaagaaacagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaagagtggatactatggaaaacagcgccatcaagatattaagagagagagtgatttcacgaaaaagtgaccttactcgtgctttccaacttcaagaccacagaaaatcaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatctttaaactgt

SEQ ID NO: 24562 - DNA, 2717 bp, Homo sapiens
gaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggctgggagaacacatccctggtcagctgtaggaaagccagagagcatttgagaagaggctgaagcttgaattttgcaaacacacaagccctctgcatttccccagagagaaggtttttttctcgtcttcatttcctttgaaacacctggggtgaggaaaaacctctacattggccaagcagaagaaacagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacagattattgatattctgtggagtgatcccagaggcaaaaatggctgttttccaaatacgtgccgaggagggggctgctattttggaccagatgttacttccaagattcttaataaataccagttgaagatgctcatcaggtctcatgaatgtaagcccgaagggtatgaaatctgtcatgatgggaaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaagagtggatactatggaaaacagcgccatcaagatattaagagagagagtgatttcacgaaaaagtgaccttactcgtgctttccaacttcaagaccacagaaaatcaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatctttaaactgt

SEQ ID NO: 24563 - DNA, 2886 bp, Homo sapiens
agaatctacctcttgaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggctgggagaacacatccctggtcagctgtaggaaagccagagagcatttgagaagaggctgaagcttgaattttgcaaacacacaagccctctgcatttccccagagagaaggtttttttctcgtcttcatttcctttgaaacacctggggtgaggaaaaacctctacattggccaagcagaagaaacagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacagattattgatattctgtggagtgatcccagaggcaaaaatggctgttttccaaatacgtgccgaggagggggctgctattttggaccagatgttacttccaagattcttaataaataccagttgaagatgctcatcaggtctcatgaatgtaagcccgaagggtatgaaatctgtcatgatgggaaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaagagtggatactatggaaaacagcgccatcaagatattaagagagagagtgatttcacgaaaaagtgaccttactcgtgctttccaacttcaagaccacagaaaatcaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatctttaaa

SEQ ID NO: 24564 - DNA, 2547 bp, Homo sapiens
gaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggctgggagaacacatccctggtcagctgtaggaaagccagagagcatttgagaagaggctgaagcttgaattttgcaaacacacaagccctctgcatttccccagagagaaggtttttttctcgtcttcatttcctttgaaacacctggggtgaggaaaaacctctacattggccaagcagaagaaacagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacagagtggatactatggaaaacagcgccatcaagatattaagagagagagtgatttcacgaaaaagtgaccttactcgtgctttccaacttcaagaccacagaaaatcaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatctttaaactgt

SEQ ID NO: 24565 - DNA, 2162 bp, Homo sapiens
attagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacagattattgatattctgtggagtgatcccagaggcaaaaatggctgttttccaaatacgtgccgaggagggggctgctattttggaccagatgttacttccaagattcttaataaataccagttgaagatgctcatcaggtctcatgaatgtaagcccgaagggtatgaaatctgtcatgatgggaaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaagagtggatactatggaaaacagcgccatcaagatattaagagagagagtgatttcacgaaaaagtgaccttactcgtgctttccaacttcaagaccacagaaaatcaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaata

SEQ ID NO: 24566 - DNA, 3414 bp, Homo sapiens
gggggcctgatctgactgacgtcagggggtgcctactccttcgaggcaagaagcctgaactttccttcctgtcactgtgaatacttggccagggctgtgaatgtcaccattgcttttcaggaagaagacatggcagactagggctgcaccttctttatgggctctgtaggtctgaaagaaatcagatcagcctgggatccctcagccaactctgaagacaggatggggatcacgcctgcatgttaaagagatttctgccttgttgtgtctcatggtaaataaaaaacccagcaaagaagcaaacagctcactgtcctctggatctgctgcgtcctgcaggagcattgcgcttaaactatgggaagcggcacctccacccaacatcattttgctttccagaatgcagagagagccttcaaggcagcagccctgatccagagatggtaccggcgctacgtggcccgcctggagatgaggcggcgttgcacctggagcatcttccagtctatagaatatgctgggcagcaagaccaagtcaagctccatgacttcttcagctatctcatggatcacttcatccccagcagccacaacgacagggacttcctgacccgcatattcactgaggacagattcgcccaggactccgagatgaagaaatgcagtgactatgaatccatagaggtacccgacagttacacggggccacgcctctccttcccactcctgcctgaccatgcaactgccctggtagaagcattcagactgaaacaacagctccatgctcgctacgtcttgaaccttttgtatgaaaccaagaaacatctggtacagctgccaaacatcaaccgggtctcaacctgttacagtgaggagatcacagtgtgtggagacttacatggccaattggatgacttaatctttatattttataagaatggcctcccgtcgccagaacggtcatatgtgttcaacggtgactttgtggatcgaggcaaggattcagtagagatcctgatgattctttttgccttcatgctggtttaccccaaagagttccatcttaacagaggaaaccatgaggaccatatggtgaacttacgatatggcttcaccaaggaagtgatgaataaatacaaggtacacgggaaggaaatactaagaaccctgcaagatgttttctgttggcttccactggccactctgatagatgagaaagttctaattcttcatggtggggtgtcagacataactgatctggagcttttggacaaaatagagaggagcaagatagtttccaccatgaggtgcaaaacgagacagaagagtgagaagcagatggaggagaagagaagagccaaccagaagagctctgcacagggacccatcccatggtttctccccgaaagccgctctcttccctcttcgccccttcggcttggctcctacaaggcccagaaaaccagcaggtcctccagcatcccctgcagcggttccctggacgggcgggagctctcccggcaggtgcggagctccgtggaactggagctagagcggtgccggcagcaagcaggcctcctggtgaccggagagaaagaggagccctcccgctcagcctcagaagcagactctgaagccggagagctgcggaagcccactcaggaggagtggaggcaggttgtagatatcctgtggagtgatcccatggctcaagagggctgcaaggccaacactattcgaggaggaggctgttattttgggcctgatgtgacacaacagttgctacaaaaatacaacatgcaattcctgatccgttcacatgaatgcaaacctgaaggctatgaattctgtcacaaccgcaaggtattaacaatcttttctgcctccaactactatgaagttggcagcaacagaggggcctatgtcaaactggggccagccctgaccccacatattgtgcagtatcaagctaacaaggtgacccacacactcaccatgaggcaaaggattagcagagtggaggagtcggctctgagagctctgagggagaagctgtttgctcattcttcagatcttctcagtgaatttaagaagcatgatgcagataaagtcggtttaatcaccttgagtgactgggcagcagcggtggagtctgtgttgcacctaggactgccatggcggatgctgaggccacagctggtgaacagctcagcagacaacatgctggagtacaagtcttggctgaagaacttggccaaggaacaactgagtcgcgagaacatacaatcaagtttgctggaaacattgtatcgaaaccgatccaacctagagaccatttttaggatcatagacagtgatcattcagggttcatctcactggacgagttcaggcagacctggaagctgttcagctctcacatgaatatcgacattacagatgactgcatctgtgaccttgctcggagcattgatttcaacaaagatggccacattgatatcaatgagttcctggaggccttccgccttgtggagaaatcctgcccagagggcgatgcctcagaatgcccacaagctacaaatgctaaagacagtggctgcagcagtccaggtgcacactaagaacagcctggtcttcatcacccaaagtgcctcataggcaatgctcagcttctcactagactatctcccttattctccatgtgaaactttatgctgaaaatttacctatccatatgcatcagaatcacctgtgtatttcagtgtggaggggtgggttggggtgttgtgtatgtatgtgttttaagtatatgagtgccccaaccccacctcacaatcttcacaaagtagaacttaggtatagtgttttcaaattctaaagtccacttcagttaagaaccactgacaatgtaactctctcattgttttcattttatacgtttttttgagatggagtttctctcttgttgcccaggctggagtgcattggcgcgatctcggctcaccgcaaagtccgcctcccaggcgattctcctgcctcagcctcctgagtagctgggattacaggcatgcaccaccacaccaggctaattttgtatttttagtagacacagggtttctccatgttggtcaggctggtcttgaactcccaacctcaggtgatccaccctcctcagcctcccaaagtgctgggattacaggcatgagccaccgcacccagcctattttatactttttatttattgtctttaacaatgtctattggtaaaggaaagttatttttaaaaattgtattgtaattccatgacccaagcatatggattttcttcattatttactttttcttacttgttactgtagtgtttatataattttatgttctacttttaaaaaaataaattaatatctaattgtaaa

SEQ ID NO: 24567 - DNA, 2154 bp, Homo sapiens
gggggcctgatctgactgacgtcagggggtgcctactccttcgaggcaagaagcctgaactttccttcctgtcactgtgaatacttggccagggctgtgaatgtcaccattgcttttcaggaagaagacatggcagactagggctgcaccttctttatgggctctgtaggtctgaaagaaatcagatcagcctgggatccctcagccaactctgaagacaggatggggatcacgcctgcatgttaaagagatttctgccttgttgtgtctcatggtaaataaaaaacccagcaaagaagcaaacagctcactgtcctctggatctgctgcgtcctgcaggagcattgcgcttaaactatgggaagcggcacctccacccaacatcattttgctttccagaatgcagagagagccttcaaggcagcagccctgatccagagatggtaccggcgctacgtggcccgcctggagatgaggcggcgttgcacctggagcatcttccagtctatagaatatgctgggcagcaagaccaagtcaagctccatgacttcttcagctatctcatggatcacttcatccccagcagccacaacgacagggacttcctgacccgcatattcactgaggacagattcgcccaggactccgagatgaagaaatgcagtgactatgaatccatagaggtacccgacagttacacggggccacgcctctccttcccactcctgcctgaccatgcaactgccctggtagaagcattcagactgaaacaacagctccatgctcgctacgtcttgaaccttttgtatgaaaccaagaaacatctggtacagctgccaaacatcaaccgggtctcaacctgttacagtgaggagatcacagtgtgtggagacttacatggccaattggatgacttaatctttatattttataagaatggcctcccgtcgccagaacggtcatatgtgttcaacggtgactttgtggatcgaggcaaggattcagtagagatcctgatgattctttttgccttcatgctggtttaccccaaagagttccatcttaacagaggaaaccatgaggaccatatggtgaacttacgatatggcttcaccaaggaagtgatgaataaatacaaggtacacgggaaggaaatactaagaaccctgcaagatgttttctgttggcttccactggccactctgatagatgagaaagttctaattcttcatggtggggtgtcagacataactgatctggagcttttggacaaaatagagaggagcaagatagtttccaccatgaggtgcaaaacgagacagaagagtgagaagcagatggaggagaagagaagagccaaccagaagagctctgcacagggacccatcccatggtttctccccgaaagccgctctcttccctcttcgccccttcggcttggctcctacaaggcccagaaaaccagcaggtcctccagcatcccctgcagcggttccctggacgggcgggagctctcccggcaggtgcggagctccgtggaactggagctagagcggtgccggcagcaagcaggcctcctggtgaccggagagaaagaggagccctcccgctcagcctcagaagcagactctgaagccggagagctgcggaagcccactcaggaggagtggaggcaggttgtagatatcctgtggagtgatcccatggctcaagagggctgcaaggccaacactattcgaggaggaggctgttattttgggcctgatgtgacacaacagttgctacaaaaatacaacatgcaattcctgatccgttcacatgaatgcaaacctgaaggctatgaattctgtcacaaccgcaaggtattaacaatcttttctgcctccaactactatgaagttggcagcaacagaggggcctatgtcaaactggggccagccctgaccccacatattgtgcagtatcaagctaacaaggtgacccacacactcaccatgaggcaaaggattagcagagtggaggagtcggctctgagagctctgagggagaagctgtttgctcattcttcagatcttctcagtgaatttaagaagcatgatgcagataaagtcggcctagcttccagccaactctgctactatcaacaaaaatag

SEQ ID NO: 24568 - DNA, 2606 bp, Homo sapiens
aaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatcta

SEQ ID NO: 24569 - DNA, 1713 bp, Homo sapiens
aaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatcta

SEQ ID NO: 24570 - DNA, 3877 bp, Homo sapiens
aaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatgggggtgctggagatctagaagacccatggtagccttaaaaaccttctaaaatgcttttgattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttgagcaatttctataggatatgtatttattattgattgttatttaatttttttccaattttacctgtattaccaaactgggttctccaataatgtccaaattgtaatgttgccttgcttcaagataaagtgtatttgggaataatattataaacccttacaaattttatgcatgtatctactgcatccttcaactctcactagaaaatcttttgaaaccaaatggattaatttatggctatttataatttgctttgacatctcactgttggaaattttttaaagatgagatttgcctttataatgtaaattgtgatttttgttttacatgtgggtttctatagttttaattttttcagcttttaagatacgagttttgtgtaatttggtatttttaatcatttatgttattttaaaagctcagaatatcacattgaaattactataaatacatttaaaattatctattttagatctaaggaaatactacagagatattttcatgggttcagtaacttttcattttataacattgggcacggtacagagtgattgtcacataaggtacttgaagatttattagtttaattctatttttacagtaaccttgaattcttctgagttttgcatgtattaaattcaattaatgctgaacatgaagagtaaagtatttatctgaaagaagtttctgggttaggagaagtaatgaatgtatccatttgtacatggtttacatgttgtggatgctttgtaaacattttcctgtatgtttaaattgtgtttcagcaggatgtaattgcccttgtgtgtagttaaaatgagtcatcatctggtcctttgtgaaatggaattcatggtattttctgtaacgttttcctgaagctgtttctggagagccacacatttaaatacagacagctttcctgatcatttgatttattgtgcacctgatttttggtctaaaaggaattattgccacaatatattttatttattctttagattttagccttgtaagttaaagtgctttacatgatgatgtgaaaagctgtttgtccctttactgggtttggggggttgttaaaagatagggaatgaagaatgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtgtgacatattactatttggtatgattcagtttttaatgttattttaaacttcttatatggttggcatatttctgaaaatttaattccaaagaggaattaaccaaactgtacaggacaatattaaccccttctgtactctagaaatatttatactccttttaaaaaaacctgcctttggccgggtgcattggctcacacctgtaatcccagcactttgggaggccaaggcgggtggatcacgaggtcaagagatcgtgaccatcctggccaacacggtgaaaccctgcctctactaaaaatacaaagattagctgggcatggtggtgcttgcctgtaatcccagctgcttgggaggctgaggcagaagaattgcttgaacccaggaggcggaggttgcagtgagctaagatcgcgccactgcactccagcctggcgacagagcgagactccgtctcaaaaaaaaaaaaaaagaaaaaaaaaaacttttccggcagggggcagggtgggggttactggtgcttgaaacagaaataatgtatgagttagtaaaagaaaaacccatattcagtgttgactcatctgaa

SEQ ID NO: 24571 - DNA, 3025 bp, Homo sapiens
aaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatgggcagaaatgatgaagaaactgttctgatggcctgcttttctgtccttttcctactgctttaaacattgattttcttttgtactaaatcatatagccaaatattgtttaagtaagtcagttttaggaaatgcttgtgttgctgttgaattataaaagctgagtaaatttcagattaaactttaaatgactgtgaaataagacataaactagttaatggtaatttgcttaaaatgacttgagattattattggaagtttttattaattgatacaggtaagaattgatatttaataaaatgttctcatgcttagactatattacttttcggtagagaaattagtattttgctgtaatgtgttatgaaatacatgtgatatcctagtttgtctactgacactggggtcttgaatcttaaaaaaaggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatct

SEQ ID NO: 24572 - DNA, 1497 bp, Homo sapiens
gcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaaggtaagacaaatgctttttaaaaatatagacaggccaggcacggtagctcatgcctgtaatcctagcacttttgtcgcctgggcgacacaccaaggctctgtctca

SEQ ID NO: 24573 - DNA, 2084 bp, Homo sapiens
ggctgaagcaaaacaaccgcctctcccctgcccacttcttgtcctcgtctgagtcgtcccttcccgtctccacgccgaagagaggcgtttagatcctccaatgagggcctaggaggactttcttagccaatcagtagccaagcccctgcaattccgggtgggaccaggcgtccacacctatagctggactgctcgttggtcccttatggcgcttcttttacgcgaggcttagaggtcaaatacaagggggcacggtcctcacagaacggaaaggatccgtacagactctccgggtttgaccgttttctaggacgaaccaatcgctttccagatacttccccgccttttgcgcgttcatttgaaaaaagccggtgtgacggacttggaaattggctcagtgactgacccgcaagaaagccagtgactgggggttcggatcacgagttggaccaataagaaaagacaatcgctggggccggggctttgctaggaggagcgcaggtgggcgttatttgattgacggagggctctacttatggctggtagcgggggctggtccctgacgttcgggaggtaggacctagcggaggcggggccgaataaagtaaatgttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggg

SEQ ID NO: 24574 - DNA, 1863 bp, Homo sapiens
gggccggttcctggggtggcccagagcaagggcaagtttcgcccgggacccgcccagctggccgggagccagtagcagggaagggccggctggcgcgagcaccgcccacgcggagccatgggggcggggcctgggcgggggcggggccgcggccgagggcggggcagggaggcagcatgctaaaccgggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgaggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctggtagagatacttcaggacccttcgccaccacccctctgcctcccaaccactccggggaccccagattcctccgatccctctcacttgcttggccctcagtcctgctggtcttcacagaaggaagtgagccacgagagcctggtagtgggggccgttgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatggataaaggtg

SEQ ID NO: 24575 - DNA, 1060 bp, Homo sapiens
atggcctcacggctcctgcatcgccatatccgagagcagctaaaggacctgaaggaagtgagccacgagagcctggtagtgggggccgttgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatgg

SEQ ID NO: 24576 - DNA, 1941 bp, Homo sapiens
gtcaaatagcagccgcggggaggctcgttcccatcggcatctgtgactggctgcgatcgagggcccgggcggccggccagccgtctcgccgagtgcggactggccggatctgctgtcagtcagcgggaacagacttctccctctccatctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcagcagctgatttctgtcatacccacatggagaaatgtattatggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactgagcatgtcaagaaactgataagatcaaaaaggtctcctaactcactagatcagcgcacaagtcagtgtaaaccacttagatagtagttttttcataaatgctcatcatatttatgttccgctgtacatgttcagtataaatatatgtgtagtgaagctactgtgagtctttaaatggaaagagcaaatgagaagtggtttggatacacttgatgagagatgagagtgtcacattaataatttttaagactcttaggcagctatgggtttcttttgatcatttttgttctttattcatttgaacacgtttttgaagttcttcaaaactagtcagtttgaattttgacagctattcaatatgtgatctccaagtttaaaaaaattttttt

SEQ ID NO: 24577 - DNA, 1092 bp, Homo sapiens
gtcaaatagcagccgcggggaggctcgttcccatcggcatctgtgactggctgcgatcgagggcccgggcggccggccagccgtctcgccgagtgcggactggccggatctgctgtcagtcagcgggaacagacttctccctctccatctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcagcagctgatttctgtcatacccacatggagaaatgtattatggatttgcttcctaaggagaagaacttggaaactctgttgaccttggcttttctagaaatagataaagccttttcgagtcatgcccgcctgtctgctgatgagaactgtgcctggtcagcagctctagacctggagcccgtggacactatatgcggggcttcagtggaaagagagatctgcttaattttgtcccaggtgaaggagtccagcggttcctatcctggactacgggaaggttcccacatctctttgtcccattag

SEQ ID NO: 24578 - DNA, 1091 bp, Homo sapiens
gagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcagcagctgatttctgtcatacccacatggagaaatgtattatggatttgcttcctaaggagaagaacttggaaactctgttgaccttggcttttctagaaatagataaagccttttcgagtcatgcccgcctgtctgctgatgagaactgtgcctggtcagcagctctagacctggagcccgtggacactatatgcggggcttcagtggaaagagagatctgcttaattttgtcccaggtgaaggagtccagcggttcctatcctggactacgggaaggttcccacatctctttgtcccattagttgagatgacttgcagtagaaattgtccacaactcttctgacctctgggactactgcaacagtagccctattgcgagatggtattgaactggttgtagccagtgttggggacagccgggctattttgtgtagaaaaggaaaacccatgaagctgaccattgaccatactccaga

SEQ ID NO: 24579 - DNA, 1589 bp, Homo sapiens
ccgggaggtgcctgggagaggcaggcagagcccagccggccgcctgcggctcagtaccgaccgtgccgcgtcgccgggctctgcgtacccctgtctctgcccaggctcccgcaaaacttttattctctggggcccccggggtgtgtgaaggaattggaaccttccgccatctccgcgctccccttcggcggcgaccgaggggacctgcgtccctcgtccgccgggctctggagccctgcgcctcacctgctgatcgctctccggagtctcgagggggcacccccggagggaccgcgcgggcgccggcgcccctgaactctcccgctcaccgcggcagacccgcccagcgcaactttaacttgattcttcttgcccaaccggggcaccagcggctgctgctgcggcggctgctgctaccgccgccgccgcggtctcacaaaggggctcagggaagggaggcggcgcgggcggcagggacgggcctccgggccgccgaggcggggagacaaaagggaagctgcctctgctcgcgctgcctgctcggagccgcttgctcggctgcctctggctgggctccgcgatcctctcccccaccctcgggcactgctccgcctccctcccggcgggctgtccccgcagtgctcccggacccggcgagccttcggggcgcgcgtcgctggtggtggttgaggctctagcgataataaatgatagaggatacaatgactttgctgtctctgctgggtcgcatcatgcgctacttcttgctgagacccgagacgcttttcctgctgtgcatcagcttggctctatggagttacttcttccacaccgacgaggtgaagaccatcgtgaagtccagccgggacgccgtgaagatggtgaagggcaaggtagccgagatcatgcagaacgatcgactcggggggcttgatgtgctcgaggccgagttttccaagacctgggagttcaagaaccacaacgtggcggtgtactccatccagggccggagagaccacatggaggaccgcttcgaagttctcacggatctggccaacaagacgcacccgtccatcttcgggatcttcgacgggcacgggggagagactgcagctgaatatgtaaaatctcgactcccagaggcccttaaacagcatcttcaggactacgagaaagacaaagaaaatagtgtattatcttaccagaccatccttgaacagcagattttgtcaattgaccgagaaatgctagaaaaattgactgtatcctatgatgaagcagttactttttgaatgactgcttggagactgcaagtaacaccttagcttcaaaatatctagttcatattaattctaaactaatttcgattttaaacaaagactttgctttaatataccactattccctccccattctctgtgctgttgtcaaccaaattatatgcttatacattataatgtcatcaataatttcataattatttctttatgcatttattttttaaattagaagaaaaaagttaacaaataagatcaaattagaacaaaatataattctttttaaattaaaatcctgcttctgtaaaaaaa

SEQ ID NO: 24580 - DNA, 10934 bp, Homo sapiens
ctccgcctccctcccggcgggctgtccccgcagtgctcccggacccggcgagccttcggggcgcgcgtcgctggtggtggttgaggctctagcgataataaatgatagaggatacaatgactttgctgtctctgctgggtcgcatcatgcgctacttcttgctgagacccgagacgcttttcctgctgtgcatcagcttggctctatggagttacttcttccacaccgacgaggtgaagaccatcgtgaagtccagccgggacgccgtgaagatggtgaagggcaaggtagccgagatcatgcagaacgatcgactcggggggcttgatgtgctcgaggccgagttttccaagacctgggagttcaagaaccacaacgtggcggtgtactccatccagggccggagagaccacatggaggaccgcttcgaagttctcacggatctggccaacaagacgcacccgtccatcttcgggatcttcgacgggcacgggggagagactgcagctgaatatgtaaaatctcgactcccagaggcccttaaacagcatcttcaggactacgagaaagacaaagaaaatagtgtattatcttaccagaccatccttgaacagcagattttgtcaattgaccgagaaatgctagaaaaattgactgtatcctatgatgaagcaggcacaacgtgtttgattgctctgctatcagataaagacctcactgtggccaacgtgggtgactcgcgcggggtcctgtgtgacaaagatgggaacgctattcctttgtctcatgatcacaagccttaccagttgaaggaaagaaagaggataaagagagcaggtggtttcatcagtttcaatggctcctggagggtccagggaatcctggccatgtctcggtccctgggggattatccgctgaaaaatctcaacgtggtcatcccagacccagacatcctgacctttgacctggacaagcttcagcctgagttcatgatcttggcatcagatggtctctgggatgctttcagcaatgaagaagcagttcgattcatcaaggagcgcttggatgaacctcactttggggccaagagcatagttttacagtcattttacagaggctgccctgacaatataacagtcatggtggtgaagttcagaaatagcagcaaaacagaagagcagtgaacccttcaggggtctcagctgccttagactaaaggactttcaacacactggtctcttttaatttagtgaaaagtgtgggagttgtaattaggatcatccaccccagacatggaatcccccctccctggtggtcttaggtctataatcagtgacgaacagagggtgcccttggccaatgtagttaagaaactggaaaatggtttcttcatgttttcccaactctttcatccagtgtccaaaatatataagtaaatagctgtagagtcacatatatgaagtgaatagcatatgtgtcatttagtctccctgaagattcttttcaagatcctgttcagggtcctccaggcatcagctgttgtgtcctctctttgtaacagtggacaggacagaccacccagtgctgcaggagacaggccactgcgtcacctgtgagtggtcaggggctgatgtggcaacaccctctgccaagagacagagctgtcctgagaatgctttgtccttctgagcccatgttttctgctcagtagcagcttggaagcagatttggaatggtttactattttggctgctcttggggactgcgagaagcagagagaatgagagaccagtggcaactgcctgcacagcagagataaccctcttcccttgcttcctttaatagttaaatagactttgtataccacctgaccagcctttgtgcatttatcctaatcatgcatgaccgttaaccttttgcttagtccttaccatatgtaataggcagctgttaaattcaccaacagataccctgatttttcatcttacgtgaccaagaaaccacgttaggggaaatgaaaaaagcaagccacaataccatgattccttccattttcaacagtagatgaaggaaatgatactgaatgagtcacagtgttccctggcaagtaagctgtttgcattgagaaaggagtgagctggtgaggttaccaccctgaattgagctccagctgccagtttttgtgtttttccttgcccctttccaagtggttttcaagtgtcaggcagtgttctgagaagcagcagcctataactgtatgtgtgttccttgaagccaggtgcagagttcccagctactgcagcttgggatttggtgggaaactactgggataagcttctccttgacaatggaaaggcagcagtcttcaacatttggttgcaaatctccatccacatcagggagctttccccaggcaaatacaaaccgccccgtggcctgcaggcctgcaggggaggcagcaaagggacctggcagttgcaacacagtaagtcaggaattcaagcgtgaacccatattgataagtgggccagaattatttaggggcctggcttgctgctctccatttcctgtatcgctaatttatcatttttccaaccttggtattttatattatttagagaaaatgctgggtcactctctttgcctaaggtgactcaaacagccaaacgaaacttccgttgcctcccagccctctgtatccacctggttttgttctttccctgtgagcatttgtggttatagcttcccatatgccacattcaccggccacctcctcgccgtggaaccctgccctctcccctcctgctgctgtagagttttcccaaagcagtgtccaggagagaatttgagagagtgaagaaattgccttgtagatgtggagggctgcaatctgtcttgatttctccaagcacttaactttctttgactgcactgagaattgctaatgatttcccatgagatttgcttacttttgtatactgtattttccagcattacagaaccttggttattgttttttagccatagaatcttctagtaaaaaatatctgccaccattttagatttaagcatttgcctatggggagacactgaatatgtggatgtgtgtattaatatttggggtggggacagggaagggaatgtggaaaacaaatgctggctgtgagcagtgctgagatggccaggccaggcggctgagtttgcttggaaattcaggacattctgactcctaagagttgcccccacccaccatcaaactgaaatcagcaccaatggtgtcagcactttacagcccatagccaactttctttatttttaacgtagcacaaaaatgtataatagcaaggaaaagacatttttaaattccggttatttttattgtctaaaatgaaagcaacagtgttttgataaagatgaaaaagaaaagctactaaattagtaaatcagtggttacgtgccctgcagaatttcttaacagatggtgctgagtgcacgagttacataactttctctctaattgaggttcacaaggcgtcttctaaattttgctttgtacaattaattcatttctgatgttaaccaaatagagtgtatatatcctactcccattactgcctctttcccccctactatggcttgtagattttcaaaagatagaagttctaggcaaaactgtagcagtttcattaatagttgttaggatagttatatctaaaatcagagtattttgttcccttccttctggagctctctctccctagcccttttccagctgttggggatgtgcagacatcactcctgggggtgccctatggtacactggctgctccccagggacctgggaatgctgaatctagccattagggaaattgatttgagatgtttgcatgtgaagcttccctaagcagcactgccaaagctttggaattgtcacccaaggcttcctagactccctagctagctcgagttcgaattgccaatagtccccatggtgccaaattttgggatggttttacagtcttttagaaatgaagacaggaatggccatgtgcttctgagaccccagcacgatgccaggcccaggtctccattaatgcagtgctctgctgctgctccactggcaatttgtactcttaacataggttgggggagggacagctagggaaattttttttaattaattgtatctaaaattctttcatcataggaataaacaacacatatagaaagctccaaagctgttcccaagacctgtattatttattttatatgaccaacttgccccaaggcaattaactctgaattgctgttctaatgtgacatatctgtgtacatatgtacatagtactggtaaccagtggctgcattttattccttgctgtggactgaggtattggcttcttgaatcttgtatatgtcataagaatattatacagagagtgttatagtgaaggatgtaagctggataatttaaaacagaccttatttcatacaagtgtaattattacatcattttgggtaaatggcaaacaggattgcatgagagtgatggcatcatcatttcaattgaatctgaagtgattctaggaaattgattccactgttggattctaggaaattgagtccactgttttcctttgcgtttaatttcctttgtgtttaatttgaccacagaaacttttttgagtagcacctagtaacattgcaaggaacttgtgtatcaaggtgtatcttgattatcctgattttttttgttctctaagttgttgccagatctctcttgcaactgtgtcaatgaaaggtctgtgtttagaaaaggcagcatatcattgtatatttgaaactataggaatatatactttgtataaaacttttccaatgatttcagaaattcttttttcctccttttgacccacaactagactgttcataccctaatagttccccaaaattgccttagcatgtcacaccagcatttgtcatccagctctggagaaatgacatgactgttagatactatgcctgtttaattgcctctggattaagtcattgatagctagacttttgagctagttagctgtagaaataatagaatccagtgtttcccaaagtgtgttccaaagaacacaagttccaaagatgctcttctaaatataggattctaggatgaaataagtttggaaaacacataccatcttagaaagttagtgaacatgagcacatcaaaggctctaatttaaatgtcctgtgaggagagaaaaacacaacaaatatctactgtcagttagcccagtgttttccagattaatttgaccacagaaacttttttgagtggcacctagtaacactgcaaggaacttgtgttctaaagaacaccctttgggaaattctggtatattgaaatattgctgtgttttcattcacgatgactcttagtagcagtacaatttgcaacttagaagcatgagcctttcatatatgaagctgacttgttaataaaagcagtgttaagaagtagtatgacttaatatgaccaacagcagcctcatattgatagcagaacaatcctacttaaagctctaaacatcatccccccctttttttttttaacggaatctcgctctgtcacccaggctggaatgccgtggcgcaatgtcaggtcactgcaagctccgcctcccaggttcacaccattctcctgcctcagcctcctgagcagctgggactacaggcggcctccaccacacctggctaattttttgtatttttagtagagacggggtttcaccatgttagccaggatggtcttgatatcctgaccttgtaatccaccagccttggcctcccaaagtgctgggattacaggtgtgagccactgcacccggccatccctttcttttatatgaataatgagcaagagccctgccatagctaaatatgtctcaaattcattccaagatctttccattgcttttttgcagttacctttgctttttgggttgaatcaaaatgaatatttttatatttcattactatatgatatttaaaaatatacagaaaatcacagaaaaggaaaaacagaaatttgattttaattcacttttgaaattttaacgatttttaaaactaatgatctgttatataataactgaaatgtaaactattaacagttatttactttctttcctttattgtcctctctggattcagtgaaataatttgaaatcaattagagctcataccttctaaaactcctgtcccatatcatcccacctttcatgttttatgtacatagttaagtttggcatgttatctcttgcctaaaatgtgaggccttcctgtagttccacagtagttactcttggctgcagaaataggtttgggaagctatgagagattaccccaaagtcatggatgaaacaaatctagtcgaaaacatggtacagagtgaattaaggcaaaagtcattaacttaaaattacatccaatatttaggaatagctcatcctctgcacattatccaaaatattttaaaaaactaaaagtaagatctcttaggctaggtggcggattgcaaagggcagggggcagttgataccatgaagcttccaatagatgcatttctaaacattttttctaatatgtaaatttgctgatccttagtaatgttaatgctttgtctatttgttatttttaccactgttgaacagcaaactgttgaggctagggttgattattgataatttttatgtgtttagtaataaccacagcatcatacgtacaactgctttaataaatccaagttaaggactttgaggagagcatgtagcaagtattcattttaacaaatcatcacagacagtttccctgttcaaagctccaccaaaaagcaagcatgcagcaaaggcatagactgtatttagagatgtggtttcatttattcttgaagtcctataaccttgcattatttaaacacaaaatcccacctaacatttgccaaatccaagttaatctcaaaaacctccgaggacattgagcacaagcagattactgtaagggcactggtggcagattgtggtggagagagggctgagtgacccagagcaaagcctgcccgggttactcgctgccacttcaggagagggattgtatcagctctcattaccttttgtcatgaggcagttcataaattaaatatgatatcatgcattatctcaaaatatttctatattaattagataattcacgatgtaaaacgtgttcatgcagaagcaaaggcggatgtaatagtcaagtatcagggaaaaacccctttaggatacccagacattaaaaatgtaaaaagtagcttataagaaatgtggattatcagatttttactatatataggttgtgtttaatagtaatttctgacacctgcacatagatgaagaaaaggcagttgttaccacttttcaccattcaaaaaatgggcttgtctcttagagtattggttaatgctttgcttatttgttaatgaagacagcattttaattttaaagcttccttttgtaggactgatggcacgggcagaatcacatttaagaaaaatggtttggaacactttttaataaaaaattgtaaaatcagtttccagtgtggtcaaaattagaatgtaaaggaaagcatttttaagaaaatacagaagcccaaatcaagggagagtaatataaaaggaaatattttaaattaagaaaaggaggtgttatagtttattacatcatgaattatgctttctgtacttacgctcttagtgaaggagataacattgaagtgagaaaatgaacattctcagttatttgcgaagttagtaaaattgcagtccctattccatttttttctgatgaaaatggatacatgagatctcatttattgctctcctcaacacctttactgtcccagattccattcacgttccaaatcgtggacagtaaaactgaagtcagataaacacagtcacaggtacaactgggagcgagttttaacatagtggtaattttgcaaatgccaacatgaatactagtgagtactcaatttacgacagacaatttcacaaaaaccaaccacagagtgatttgatattcttgcttcttagagagttttctaatccatataatgcaatgggtcaggttgctcatatgattaaaaaaattaatcctgtagaaatgatgtattagacatctctaacccaagaaaaagatgtcttttgtataacttttaaattcccatttgtctatcttaggacaaatgatgacttcttcgtgtagtaatgaaaacgtctaaatcctgctctgtggagaaaagctagaaccatgggacattaagcaagaatactcctctgatttaggctcccagactacaactaacagtctttatgtatttatcatcttggttattgttttatctcaagcatatacagtgtgcagaaagtagaataatgaataaaatatgaccatggagaaaacccataacttttgcttctattatagaaagcagtgtttgttctttttaatttattacatgttcacattgaaacattaacatctacaatattgtctttcagtttactcttcaattactaaagcaaatgattttgatttatagcacttacacaactgcagttcaggtcacagaattgaaatctatttgataatgtctcagcattctcatgggcagccaggaaaaaaaaaaagagagagaaagacaaatagaaattttagtgggttcagataaatgattattctgacaaacctggaaaatagtaattaaacagttcattccaaaagaccccaatgtaaactctgctcacatacataatttgtataaggaaaatgtatgagtttttttcttaaaaataaatagaagcatcattgcatttataacagattgatcaatcttatgaacagattacattgggaaagtcactattattgctgtgtgtttgtatattttattctttccttttttgtgtgagcatctactatgtgccaggcagtgactgtgtctgagtgaatgtatccatggtgagcactcaggcgccatcactgccttcttggggcttacaccctattggggtgtcagagatattataacactcaatattgacccaatgggatgaaaattgttatcttcatgatttcttccaatgggcttagatttgttgggacagggcagaattagaataattatttctcacatataagagtaagtgatatgagattgggaatttcttgccaacactcaagcaaactgcagaagataattactccattttactagctcacctagtttctgaaggatggggtggggagtgagacatggagcctctggggacaaggataggggggtgggactgtcccagtggagggtgccactggaagcctccacccaagtgggccagcagctgtgcaagggtgcagcagtaggctggtgaaagccaggttgtccagatctttctaggggaagagaaggattatagaaaaggagaaaagggaggagcaagaacatctctccatggcctatttttatttttgttcccaagagactagtgtaataaccttatgcccccaaagacagcccagaactgagtatcttcagtgttcctgagtgtaaatcagtgaatctgttatatagaaagttaacatttcaggagcacaattatttcctgatttcaaatatgaacagaagactaaatgtcatttttttaaatcataaatttggtatccatagttactttacacattccagagtctaagcatggaatttaagttttgtattttgaacaaaaatagcaacatctgttttctgtatggcaaagaaaaactaaatcccagacttttatttttaaccacagaaaccatcacttctttctaaattatttgcttgcctgctcatttcccctaaacatctctgtttatgccaatggctttttaaatccaaataatactagttattgccaaattgcattagaatcctattgaattagaataattcatatacttcatatactaggcagtaaatggttagagacggtaaagatctgattgtgatcaaaagtagggtttttgttttgtttttaatcatgagcacatataaaaggaaattcaaatgaaaccaagccaatttctgatttagtaagattaaaaccatagatggagctcagttattaaggatggaaaggaggaaagcacagagtgaggagagaaaaaggggaaggaaaaaaagtagtgtttttttggggaacagtataatgtctcagaagttcttctctcttatcctgctgatgttgagacagtggctttgtataagcttttatttatacctatttcaacatcatgaaaatttttccatcagcattttcttgcaactttaaaaatcacaagggattatttgtttataaagagatacaggatctataatttattggcaatactttattttaggaatcttcaaattgtacttaataaataaatcacaggtcaaaatgactgtaaaatcaatcaggctttctcgtaagttatttcctgaaaaccatccatgataaatacaacaaggcttggcgaaacctcattactcttggaagtcttcagaggttattatacctactgatctgtatttgtctctaagagacatttgaaacacagttacaatgtcaatttggtgtaacattacctgtagtagagctcagagtatatggcagtgcacggtcactcaagatgcatggcgtgtcatttgggtcgctttgatgggtgctcgggtagaattagccttgtagagactaatgtgttcatgctatctctgatcctgtggtgttgtataaaaatgaacagctaaaaatttacccatgacaagattaaagcaaaaataaacacaaagttgttagactttaaacatga

SEQ ID NO: 24581 - DNA, 2429 bp, Homo sapiens
cttgccctcacctccgaatcctgacaacttcccggtcatcccgacccagcgttttccttgggattccgacctccccctcagagaagacaggaggtcgggaaggacctgcagcccaggggcttccaagatgaggcccagagactcggattatcaatgcagagaaatctgaattcaatgaggatcaagccgcctgtgggaagctgtgcatccggagatgtgagtttggggctgaagaagagtggctgaccctgtgcccagaggagttcctgacaggccattactgggcactgttcgatgggcacggcggtcctgcagcagccatcttggctgccaacaccctgcactcctgcttgcgccggcagctggaggccgtggtggaaggcttggtggccactcagccccccatgcacctcaatggccgctgcatctgccccagtgaccctcagtttgtggaggaaaagggcatcagggcagaagacttggtgatcggggcattggagagtgcctttcaggaatgtgatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggtactgtagctgctggggacctgcctgggcctgggttggtgccagcagcaagcccaagtagttatggctgagaagacagagcactgacaatgagctggcagctggccaggatcagggctgtctcaagcttcttggaggaggcagggagaccgtgggttccgaaaatccctggatttagactctcatggtccagcccgtggccctcccagacttgctgcttgcttggtccacagtcggactgcattgcttgggtccccatgtccagccttgtgcagtgagttctcctaaggtctggccttgcccctttgctctgcccctgaagtctatctgcaggatggtcttcacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacag

SEQ ID NO: 24582 - DNA, 2041 bp, Homo sapiens
cccgacccagcgttttccttgggattccgacctccccctcagagaagacaggaggtcgggaaggacctgcagcccaggggcttccaagatgaggcccagagactcggattatcaatgcagagaaatctgaattcaatgaggatcaagccgcctgtgggaagctgtgcatccggagatgtgagtttggggctgaagaagagtggctgaccctgtgcccagaggagttcctgacaggccattactgggcactgttcgatgggcacggcggtcctgcagcagccatcttggctgccaacaccctgcactcctgcttgcgccggcagctggaggccgtggtggaaggcttggtggccactcagccccccatgcacctcaatggccgctgcatctgccccagtgaccctcagtttgtggaggaaaagggcatcagggcagaagacttggtgatcggggcattggagagtgcctttcaggaatgtgatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctac

SEQ ID NO: 24583 - DNA, 1790 bp, Homo sapiens
cccgacccagcgttttccttgggattccgacctccccctcagagaagacaggaggtcgggaaggacctgcagcccaggggcttccaagatgaggcccagagactcggattatcaatgcagagaaatctgaattcaatgaggatcaagccgcctgtgggaagctgtgcatccggagatgtgagtttggggctgaagaagagtggctgaccctgtgcccagaggaggatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacagaa

SEQ ID NO: 24584 - DNA, 1380 bp, Homo sapiens
atgtccgccggctggttccggcgccgcttcctgcctggggagccgctccccgcgccgcggccgcctgggccgcatgccagccccgtgccctaccgacggccccgcttccttcgcggctccagctccagccccggggcggccgacgcctcgcgccgcccagactcccggcccgtgcgcagccccgcacgaggacgcacgctaccctggaatgcaggctacgccgagattatcaatgcagagaaatctgaattcaatgaggatcaagccgcctgtgggaagctgtgcatccggagatgtgagtttggggctgaagaagagtggctgaccctgtgcccagaggagttcctgacaggccattactgggcactgttcgatgggcacggcggtcctgcagcagccatcttggctgccaacaccctgcactcctgcttgcgccggcagctggaggccgtggtggaaggcttggtggccactcagccccccatgcacctcaatggccgctgcatctgccccagtgaccctcagtttgtggaggaaaagggcatcagggcagaagacttggtgatcggggcattggagagtgcctttcaggaatgtgatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactga

SEQ ID NO: 24585 - DNA, 4087 bp, Homo sapiens
tgccagtattattattttacctacaaaatgagcaaagatgtttagaagtacaatagaattcagccctgctgagggtaacaaaaggagggtacttttccggtgaggctttgtgcagaaggcaaattaataaagggagcattcagtaattacacctctaggaatcagccgtacgaaaatgcaggatgcatttataaatacatacatacacaaagatttatgtatgaagatattcagcccagccttatcttttaaattatcatctaaatatcaatagcagaatgggcgagatatctacacaccaggattcatgccaccatgccaccatgaatcactgggaaaaaacggtgatatataagcatttagggatgtaacatgttcatcgaggaaaggaggctacaaaagtaatgtctattttgagttttaaatttttcatgtaacgatttagaaactcatctaatttgataacgtgacttaggcaaatcattcaaatctttttgcgtttcctctgcaatggcgattgtggaggttaaatgggataactggcgttgaaacgttccaggcccatgagcaggactcaatgttccttcccttcccctttagtgtatggcttcttacatctggggaagagtcccaccaaagatcgattccaagcttcgcttcttggatgagcgagggaaactaggcgctaacttacctattcacccccgcgcccgttcccggcagccgggactcagggaagccaggtagccgcggtgctctcaactccctccccgcccgcgcacttcgaatccaaactgcgcggggcgaggcggggcggcgctccgatgaggtagctggcttgggagaggagtcccttgaggctgccgccaagccagggaagcgggaggcgcaggccacgcccggccactcacagacagtgacgtcatcccccgccgccactccggcgcttcccaggccctgctcgcgagtccccaccccgattgcgcacccgcgacttcagcccgaggggcggggattttcttggagcgacgggacgcgacgccaatcgcgacgaggcttcgccccgtggcgcggtttgaaattttgcggggctcaacggctcgcggagcggctacgcggagtgacatcgccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattctta

SEQ ID NO: 24586 - DNA, 2987 bp, Homo sapiens
gcttcgccccgtggcgcggtttgaaattttgcggggctcaacggctcgcggagcggctacgcggagtgacatcgccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtgcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttc

SEQ ID NO: 24587 - DNA, 3032 bp, Homo sapiens
gtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgaaggatccgtccctctctgacagttccactgttgggcttcagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 24588 - DNA, 2060 bp, Homo sapiens
ggagcggctacgcggagtgacatcgccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtgcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaa

SEQ ID NO: 24589 - DNA, 806 bp, Homo sapiens
cgcgcagcacggctcagaccgaggcgcacaggctcgcagctccgcggcgcctagcgctccggtccccgccgcgacgcgccaccgtccctgccggcgcctccgcgcgcttcgaaatgagggtcctgggtgggcgctgcggggcgctgctggcgtgtctcctcctagtgcttcccgtctcagaggcaaacttttgtttatattttagaaatgattttatatacaaccgtgcatgcatttctgtattggtcggcttatctggatgcaattttttctattctatatgctttttgtcaaagcaacaggcttcacaagtcctggttaggaagcgtcgtgcaaattctttacttgaagaaaccaaacagggtaatcttgaaagagaatgcatcgaagaactgtgcaataaagaagaagccagggaggtctttgaaaatgacccggaaacggattatttttatccaaaatacttagtttgtcttcgctcttttcaaactgggttattcactgctgcacgtcagtcaactaatgcttatcctgacctaagaagctgtgtcaatgccattccagaccagtgtagtcctctgccatgcaatgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgt

SEQ ID NO: 24590 - DNA, 3556 bp, Homo sapiens
aaaagcagcaactagggagctggtgaagaaggatgtctcagcagtgtttactaggcctccaacactagagcccatcccccagctccgaaaagcttcctggaaatgtccttgttatcacttcccctctcgggctgggcgctgggagcgggcggtctcctccgcccccggctgttccgccgaggctcgctgggtcgctggcgccgccgcgcagcacggctcagaccgaggcgcacaggctcgcagctccgcggcgcctagcgctccggtccccgccgcgacgcgccaccgtccctgccggcgcctccgcgcgcttcgaaatgagggtcctgggtgggcgctgcggggcgctgctggcgtgtctcctcctagtgcttcccgtctcagaggcaaactttttgtcaaagcaacaggcttcacaagtcctggttaggaagcgtcgtgcaaattctttacttgaagaaaccaaacagggtaatcttgaaagagaatgcatcgaagaactgtgcaataaagaagaagccagggaggtctttgaaaatgacccggaaacggattatttttatccaaaatacttagtttgtcttcgctcttttcaaactgggttattcactgctgcacgtcagtcaactaatgcttatcctgacctaagaagctgtgtcaatgccattccagaccagtgtagtcctctgccatgcaatgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaattttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaacagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataattttaaaatgcatgtgaatatctttattatatcaactgtttgaataaaacaaaattacataatagacatttaactcttca

SEQ ID NO: 24591 - DNA, 3481 bp, Homo sapiens
gagaatggcggcggcggcggcggcggcggcggccgctgccattgcccggagatggccggcagagccgccgagacgccgaagagcccgccgcccgcgcgaggtgtagacggggcactgccttcagagcaggtcctgccagcctcgctggagaggatgccctcgtgtccgtgatgggctgtgggacaagcaaggtccttcccgagccacccaaggatgtccagctggatctggtcaagaaggtggagcccttcagtggcactaagagtgacgtgtacaagcacttcatcacagaggtggacagtgttggccctgtcaaagccgggttcccagcagcaagtcagtatgcacacccctgccccggtcccccgactgctggccacacggagcctccctcagaaccaccacgcagggccagggtagctaagtacagggccaagtttgacccacgtgttacagctaagtatgacatcaaggccctaattggccgaggcagcttcagccgagtggtacgtgtagagcaccgggcaacccggcagccgtatgccatcaagatgattgagaccaagtaccgggaggggcgggaggtgtgtgagtcggagctgcgtgtgctgcgtcgggtgcgtcatgccaacatcatccagctggtggaggtgttcgagacacaggagcgggtgtacatggtgatggagctggccactggtggagagctctttgaccgcatcattgccaagggctccttcaccgagcgtgacgccacgcgggtgctgcagatggtgctggatggcgtccggtatctgcatgcactgggcatcacacaccgagacctcaaacctgagaatctgctctactaccatccgggcactgactccaagatcatcatcaccgacttcggcctggccagtgctcgcaagaagggtgatgactgcttgatgaagaccacctgtggcacgcctgagtacattgccccagaagtcctggtccgcaagccatacaccaactcagtggacatgtgggcgctgggcgtcattgcctacatcctactcagtggcaccatgccgtttgaggatgacaaccgtacccggctgtaccggcagatcctcaggggcaagtacagttactctggggagccctggcctagtgtgtccaacctggccaaggacttcattgaccgcctgctgacagtggaccctggagcccgtatgactgcactgcaggccctgaggcacccgtgggtggtgagcatggctgcctcttcatccatgaagaacctgcaccgctccatatcccagaacctccttaaacgtgcctcctcgcgctgccagagcaccaaatctgcccagtccacgcgttccagccgctccacacgctccaataagtcacgccgtgtgcgggaacgggagctgcgggagctcaacctgcgctaccagcagcaatacaatggctgagccgcctggctgtgcacacatgcagcacgacccagcctggccacacactgtggtgccatctgggtccgatgccctctctggagataggcctatgtggcccacagtaggtgaagaatgtctggctccagccctttctctgtgccttcagcagcccctgtcctcaccatgggcctgggccaggtgtgacagagtagaggtagcacagggggctgtgactccccctgaactgggagcctggcctggcactgatacccctcttggtgggcagctgctctggtggagttgggaagggataggacctggccttcactgtctcccttgccctttgacttttccccaatcaaagggaactgcagtgctgggtggagtgtcctgtggcctcaggaccctttgggacagttacttctgggaccccctttcctccacagagcccttctccctggtttcacacattcccatgcatcctgatccttaagattatgctccagtgggagaccctggtaggcacaaagcttgtgccttgactggacccgtagcccctggctaggtcgaaacagccctccacctcccagccaagatctgtcttccttcatggtgcctccagggagccttcctggtcccaggacctctggtggagggccatggcgtggaccttcacccttctggactgtgtggccatgctggtcatcggcttgcccaggctccagcctctccagattctgaggggtctcagcccaccgcccttggtgccttctttgtagagcccaccgctacctccctctccccgttggatgtccattccattccccaggtgcctccttcccaactgggggtggttaaagggagccccactgctgctacctggggaatggggcacctgggggccaaggcagagggaagggggtcctcccgattagggtcgagtgtcagcctgggttctatcctttggtgcagccccattgccttttcccttcaggctctgttgctccctcctctgcagctgcacgaaggcgccatctggtgtctgcatgggtgttggcagcctgggagtgatcactgcacgcccatcgtgcacacctgcccatcgtgcacacccacccatggtgcacacctgtagtcctccatgaggacatgggaaggtaggagttgccgccctgggggagggtcccgggctgctcacctctccccttctgctgagcttctgcgcacccctccctggaacttagccatactgtgtgacctgcctctgaaaccagggtgccaggggcactgccttctcacagctggccttgccccgtccaccctgtgctgcttcccttcacagcattaaccttccagtctgggtcccactgagcctcaagctggaaggagcccctgcgggaggtgggtggggttgggtggctgctttcccagaggcctgagccagaaccatccccatttcttttgtggtatctccccctaccacaaaccaggctggaacccaagccccttcctccacagctgccttcagtgggtagaatggggccagggcccagctttggccttagcttgacggcagggcccctgccattgcaggagggtttggttcccactcagcttctgccggtcggcagcctgggccaggcccttttcctgcatgtgccacctccagtgggaaacaaaactaaagagaccactctgtgccaagtcgactatgccttagacacatcctcctaccgtccccaatgccccctgggcaggaggcagtggagaaccaagccccatggcctcagaatttccccccagttccccaagtgtctctggggacctgaagccctggggcttacgttctctcttgcccagggtgggcctggtcctgagggcaggacagggggtttggagatgtgggcctttgatagacccacttgggccttcatgccatggcctgtggatggagaatgtgcagttatttattatgcgtattcagtttgtaaacgtatcctctgtattcagtaaacaggctgcctctccagggagggctgccattcattccaaca

SEQ ID NO: 24592 - DNA, 2526 bp, Homo sapiens
gtgcagatcgtggctgacagaggaacgggggtattgagcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatggtcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtaca

SEQ ID NO: 24593 - DNA, 2472 bp, Homo sapiens
ccgcggcgtccacactcgccgcgcgcgcggcggccgggctggaccttgctggcccgcggcgccatgagccgcagcctggactcggcgcggagcttcctggagcggctggaagcgcggggcggccgggagggggcagtcctcgccggcgagttcagcaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgca

SEQ ID NO: 24594 - DNA, 1648 bp, Homo sapiens
ctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaattatattgagaacttgtggatcacactgtatttgaaattattaatgctggatgttaaaaggtcactaaaaagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggggagattactttgtattgtactgccattcctactgtatttttatactttttggcagcattaaatatttttgttaaata

SEQ ID NO: 24595 - DNA, 3424 bp, Homo sapiens
ggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttctacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatctagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaa

SEQ ID NO: 24596 - DNA, 5839 bp, Homo sapiens
tctcctctggatcttaactactgagcgcaatgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgcca

SEQ ID NO: 24597 - DNA, 5038 bp, Homo sapiens
ccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggagcccttcagattgagcagagtgaagagtctgaccaaggaaaatatgagtgtgttgccaccaacagcgcgggcactcgctattccgctcctgccaatttatatgtcagagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaatgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggttcagatgattccggttaccctggtaaccttcattcttcaagtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaagggga

SEQ ID NO: 24598 - DNA, 5941 bp, Homo sapiens
gcggcgtagagaagctcgcagccctccggagcctcagcgatctcctggctcgcttttcccgcagccgccgagcagcgcaggcccggcgactccgggtgcagctggccctgtgcggtgacatcgccgtccggcgccaggctcgaagccgcctggccgcgcccgcggggtcgcaggccgctggtcccgcccggccgcgctcacaaactactcgcggctcgtgacccgggacaaacttctggcggcggcgcagcctcttccacagtcaccctccccagagccagctaccaaaatagaagacgcggccggggcgaggaggtgggcggggggagcccggtggccgctcctccccgcgcggctgacgcccgcttcggcggcggtagtggctgtggccgcggggccgcccccagccgagctcccggaggcgctcgggcgcgggccggcggggcacgggcgctcacgccctctagcgggccgcggcggcgccgggcggccgtgacgtgagcgctcccttcagccggcctgcggggcaccgccagtcagtcggggagcaagagccccgcgcgcagccggcgcgggctcggtcatcggcgcgccgccgcccggggctgggcttggggctgcctgtggagaggcggcgggcggaacgcgcgcggccacggccacggccaccgccacggccacggccggcagctcgggtcccgggtcccgggcaggggaaggggagaggcggcgagctcagcaaccggaaccgagggaagattttggctccgcgggctcgccctccgctccctctgccagcggcgccagacgccgagtggggccagggacaggggaggaggacccaggaccctgtgcccgcgcccctggagccgctggagttcggacttctgcaactgttggcactttgggggcttggcttagcgctctgctgtttacccgtctctcctcgctgcctcggaaccaaagctcccggccccctccgccctcgcgcgcccacccaccgccgccggggagcggcccggcccgcactcagcaccatgaggggacttgggacttgcctggcgactttggccggacttttgctaactgcggcgggcgagacgttctcaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagacccatttgtgccaactgcaattttagtgccaataaatgatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagata

SEQ ID NO: 24599 - DNA, 5337 bp, Homo sapiens
ccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggagcaagtgcgaatccaccctggcacccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacagcccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcggccgaggccgaacgcttcctcttgcaacggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagccaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatattcggataaaccgagaaggttaccacaggtcaaaccacttcatagccactcaagggccgaagcctgagatggtctatgacttctggcgtatggtgtggcaggagcactgttccagcatcgtcatgatcaccaagctggtcgaggtgggcagggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggaaccgcgacaagaaccgcagcatggacgtcctgccgcccgaccgctgcctgcccttcctcatctccactgatggggactccaacaactacattaatgcagccctgactgacagctacacacggagtgcggccttcatcgtgaccctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcgggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatagcggggccctggcctggggcacccactgcacactcagggccagacccaccatcctggactggcgaggaagatcagtgcctcctgctctgcccaaacacactcccatggggcaagcactggagtggatgctgggctatcttgctcccccttccactgtgggcagggcctttcgcttgtcccatgggcgggtggtgggccaaggaggagcttagcaagtctgcagcccagccccacctccatagggtcctgcaggcctgtgctgagaggcctggtgctgcctggcagagtgacaaaggctcaggacggctggctctgggggactcaggccaagccccttggcaccatcctggcttttggcagggatgagtgaggccctgcagagagcatcccaggccaaggttcccactcagcctgccccctctgcatgtgggtagaggatgtactgggacttggcatttaggattccatctggcccagcccctgaaggtcctggggaagcaggtctcaattctgaatagccagtggggcacactgactgtcctccccaggggaactgcagcgccctcctccccactgccccctgcagcccctgagatattttgctcactatccctccccacttgcttccctgatatgtgctctgagcttccctgaaccaggatctgcctattactgctgtgccccatggggggctccttccctgcctgacccactgttgcagaatgaagtcacctcgcccccctcttcctttaatcttcaggcctcactggcctgtcctgctcagcttgggccagtgacaatctgcaaggctgaacaacagcccctggggttgaggcccctgtggctcctggtcaggctgcccgttgtggggaggggcagtgttagagcagggctggtcataccctctggagttcagaggaagaggtaggaccagtgcttttttgtttcttttgttatttttggttgggtgggtgggaaggtctctttaaaatggggcaggccacacccc

SEQ ID NO: 24600 - DNA, 4627 bp, Homo sapiens
cgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatgaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaa

SEQ ID NO: 24601 - DNA, 3932 bp, Homo sapiens
ggggcggcggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaaacaaaaaacaacaccaaaaaaacagcagtgatatatatatatatatatatatatatatatatatatatatatatatatatatatatatatatatataatataatatatatatatatatatatattttccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgctc

SEQ ID NO: 24602 - DNA, 1952 bp, Homo sapiens
gcggcggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaaacaaaaaacaacaccaaaaaaacagcagtgatatatatatatatat

SEQ ID NO: 24603 - DNA, 1032 bp, Homo sapiens
gtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaata

SEQ ID NO: 24604 - DNA, 830 bp, Homo sapiens
agtaaaaccatgttacagccttctgtgggaagccatttggatgtcggggtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttcta

SEQ ID NO: 24605 - DNA, 900 bp, Homo sapiens
gggggagagtgagttggtgaagggagggcgtgagcttgatcctggatagtgtttgtatgatgtgcacacgtctctgcaaatgcttgtttgaagattggctgtgctgcattttggtataattgggaggtgacatattgtcccttatctcagtaaacatttggaggaagaggacgagaaagattgaattttgcattctttaattgggaagaaaaggaaggtgaatccatgttgagctgagctagtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccct

SEQ ID NO: 24606 - DNA, 1332 bp, Homo sapiens
tgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtg

SEQ ID NO: 24607 - DNA, 1257 bp, Homo sapiens
tgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccggaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtg

SEQ ID NO: 24608 - DNA, 1866 bp, Homo sapiens
aagccggtggagccgcggccgcgcctgtgcgcgagggcgcgcgcgtcccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccggaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtg

SEQ ID NO: 24609 - DNA, 1717 bp, Homo sapiens
ctaagccggtggagccgcggccgcgcctgtgcgcgagggcgcgcgcgtcccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctg

SEQ ID NO: 24610 - DNA, 558 bp, Homo sapiens
gtgcgcgagggcgcgcgcgtcccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttg

SEQ ID NO: 24611 - DNA, 3406 bp, Homo sapiens
agctgggggttggggttggcgctagcgcagcggctcgcctggtactgtgggagagcggcggctgctcctggaagttgtggtgtcgggagcccagccggtgccgccgcagccgccgcctagggcggtggggaggaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatggtcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgcc

SEQ ID NO: 24612 - DNA, 2316 bp, Homo sapiens
gtcgaggcaaggtatctggctgtgaccgggaggagtgcagatcgtggctgacagaggaacgggggtattgagcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatggtcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatga

SEQ ID NO: 24613 - DNA, 2253 bp, Homo sapiens
gtcgaggcaaggtatctggctgtgaccgggaggagtgcagatcgtggctgacagaggaacgggggtattgagcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatggtcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattgg

SEQ ID NO: 24614 - DNA, 7546 bp, Homo sapiens
cgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatg

SEQ ID NO: 24615 - DNA, 7925 bp, Homo sapiens
caattcttgtttaccaaggtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctagatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaacaagccaaaactgtgtgcag

SEQ ID NO: 24616 - DNA, 8119 bp, Homo sapiens
cgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctaggaatgactatgcatagttctggaaactcttcatcccaagtacccttaaaagaaaatgatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatg

SEQ ID NO: 24617 - DNA, 8487 bp, Homo sapiens
gagtagctccagcggccacgctgaggcgagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcttggagaggcgtcgagcacagtagggcggcgggggtgcgttgagcgctcgggggtcaggcagtcggccgggatcgccgctggggagcgtttccgaggcgaggaggaggaggaggagatgctgctcctcttctccccctccccaggctccttctacagctccttcagcccacgcccgcagccgcttgtgggagaagtggtggtggctctcggcgcccgcggcggctgccggcggcccgccccgacgccgcgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctagatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaacaagcc

SEQ ID NO: 24618 - DNA, 8573 bp, Homo sapiens
gagtagctccagcggccacgctgaggcgagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcttggagaggcgtcgagcacagtagggcggcgggggtgcgttgagcgctcgggggtcaggcagtcggccgggatcgccgctggggagcgtttccgaggcgaggaggaggaggaggagatgctgctcctcttctccccctccccaggctccttctacagctccttcagcccacgcccgcagccgcttgtgggagaagtggtggtggctctcggcgcccgcggcggctgccggcggcccgccccgacgccgcgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctaggaatgactatgcatagttctggaaactcttcatcccaagtacccttaaaagaaaatgatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacggtactgtttgacaagggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaacaagccaaaactgtgtgcag

SEQ ID NO: 24619 - DNA, 516 bp, Homo sapiens
agctccctcgcagaaaatggggcaatcgggtttgttttcaaggcaggacctgaacaaaatgtaggacacctgatctgtgggatgaagggcgctggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgtt

SEQ ID NO: 24620 - DNA, 8076 bp, Homo sapiens
gtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctaggaatgactatgcatagttctggaaactcttcatcccaagtacccttaaaagaaaatgatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacggtactgtttgacaagggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatg

SEQ ID NO: 24621 - DNA, 4173 bp, Homo sapiens
ccgcgcgggactccggggcgccacgggggccatgtaagcagctatcttccagagggccacactgggcatggacacccttttccctgcctggaggagcacaggtgatagtgtaattttccagtcacgaaactgctaaggccatctcaggggcgtgtgcgccaggataggcgggcggcgtccgaggaccacatagccatgccttttggtctgaagctccgccggacacggcgctacaacgtcctgagcaagaactgctttgtcacacggattcgcctgctggacagcaatgttatcgagtgcacgctgtcggtggaaagcacagggcaagaatgcctggaggctgtggcccagaggctggagctgcgagagacgcactactttggcctttggtttctcagcaagagccagcaagcacgatgggtggagctggagaaacctctgaagaaacatctggacaaattcgctaatgagcctttgcttttctttggagtcatgttctatgtgccaaatgtgtcatggcttcagcaagaggccacaagatatcagtattacctgcaagtcaaaaaagatgtgcttgaagggcgattacgatgtacattggaccaggtgattcggctagccggcctagctgtgcaagctgattttggagactataatcagtttgattctcaagatttcctcagagagtatgtgctatttcctatggatttggccctggaagaggctgttctggaggagctgacccagaaggtagcccaagaacacaaagcccacagtggaatcctgccagcagaagctgaactgatgtacatcaatgaagttgaacgtttggatggatttggacaggaaatcttccctgtaaaggacaatcatggaaactgtgtacaccttggcattttctttatggggattttcgtgaggaacagaattggaagacaagcggtaatatacaggtggaatgacatggggaatatcactcataacaagtcgaccattctagtggagctcatcaacaaagaagagactgccctctttcacacggatgatatcgaaaatgccaagtatatttctcggttgtttgccacacgacacaagttttacaaacaaaacaaaatctgcactgaacagtcaaattctccaccccccatcagacgccagcccacctggagccgatcctctctgcccaggcagcagccgtacatcctgcctcccgttcacgtccagtgtggtgagcactactcggaaacgcacacctcgcaagacagcatttttcatgggaatgaagaagccttgtattgcaactctcacaacagcctggacttaaattatttaaatggcactgtcaccaatggcagcgtgtgtagcgttcacagcgtcaactccctcaactgctcgcaaagtttcatccaggcctcccctgtatcctccaacctcagtatccctgggagtgacatcatgcgggccgactacatcccgagccaccggcacagcgcgatcatcgtgccctcgtacaggccaacccccgattatgagacagtcatgcgccagatgaagagggggatcctgcatacagacagccagagccagtctctgagaaacctcaacattatcaacacccatgcctacaaccagccagaggatctggtgtacagccaaccggagatgcgggagaggcacccctacactgtcccttatgggccacagggggtctacagcaacaaacttgtcagtccatctgaccagaggaacccaaagaataatgtggtaccaagcaagccgggggcaagcgccatctcgcacacggtgagcaccccagagctggccaacatgcagctgcagggcagccataactacagcacggcccacatgcttaagaactatctcttcaggccaccgcccccctacccacggccacgacctgccaccagcaccccagacctggccagccaccgccacaagtacgtcagcggcagcagcccggacctggtgacccggaaggtgcagctctcggtgaagaccttccaagaggacagctctccggtggttcatcagtctctccaggaggtgagcgagcccctcacggccaccaagcaccacggcactgtgaacaagcgccacagcctggaggtgatgaacagcatggtgcggggcatggaggccatgacgctcaagtcgctccacctccccatggctcgccgcaacacgctccgggagcagggaccgcccgaggaggggtcaggcagccacgaggtcccccagctccctcagtatcaccacaagaagaccttctctgatgccactatgctaatccacagcagcgagagtgaggaggaggaggaggaggctccagaatcggtgccccagatccccatgctccgggagaagatggagtacagtgcccagctgcaggcggccctggcccgcatccccaacaagcccccgcctgagtaccccggtccaaggaagagtgtgagcaatggggctctgaggcaggaccaagccagccttcctcccgccatggccagagccagggtgctgaggcatgggccagccaaggccatcagcatgtctcggactgacccgccggctgtcaacggggcctctctcggcccatccatctcggaacccgacctgactagtgtgaaggagcgggtcaaaaaagagcctgtgaaggagagacctgtgtctgaaatgttttccctggaagacagcattatagagagagagatgatgatcaggaatctagagaagcagaagatggcaggcctggaggcacagaagaggccgctgatgttggcagcattgaatgggctctcggtggctcgagtctcagggcgggaagagaatcgagttgatgccacccgggttcccatggacgagaggttcagaaccctgaagaagaaactagaagagggaatggtgttcacagaatatgagcaaattccaaagaaaaaggcgaatggcattttcagcacagcagctctgccagaaaacgccgagcgcagccgaatccgtgaagttgtcccctatgaggagaatcgagtagagctgataccaaccaaagaaaataacacaggatacattaatgcctcccacatcaaggtggtggttggcggggcagaatggcactacatagccacccaggggcccctgccacacacgtgccacgacttctggcagatggtgtgggagcagggagtgaatgtgattgccatggtcactgcagaggaggagggtggacgaaccaaaagccaccgatactggcccaaactaggttcaaagcacagctcagccacctatggcaagttcaaggtcaccacgaagtttcgaacggattctgtttgctatgcaaccacgggcttgaaggtcaagcaccttttgtctgggcaagaaaggacggtgtggcatttacaatatactgactggccagatcacggctgtccagaagatgtccaaggatttttatcctacttggaggagatccagtcggtccgtcgccataccaacagcatgctggaaggcaccaagaaccggcacccgcccatcgtggtccactgtagtgctggggtgggaaggaccggcgtgctcattctttctgagctgatgatctactgcttggaacataacgaaaaggtggaagtgcccatgatgctgaggctcctcagggagcagaggatgttcatgatccagactatcgctcagtacaagtttgtctaccaagtcctcatccagttcctccaaaactccagactcatttaatcaccccaatccagctcctggaggagggacccagctccatcgcgctggaggagagtcacctccagacaacatctgctccccccacaggggtgcaggtggctggcagcaaacaggctctctgaagacagtagccaagattattcacacataccatgtattattttatatgagataatttatttttttcccctttggaataacttttgtgaattattataatgcagtttccctagtaatatagtacttttcatttgaaccacatcttgactgatctgtattgtaatatatgtcagcaggtaaggttgcctgctggatcattttgaggacagaggcatgagggagcacatctcttgtgaagttgcagccagatttgtaaccaaccctgaaattcatcagcttaattcatttatcagc

SEQ ID NO: 24622 - DNA, 3473 bp, Homo sapiens
atgccttttggtctgaagctccgccggacacggcgctacaacgtcctgagcaagaactgctttgtcacacggattcgcctgctggacagcaatgttatcgagtgcacgctgtcggtggaaagcacagggcaagaatgcctggaggctgtggcccagaggctggagctgcgagagacgcactactttggcctttggtttctcagcaagagccagcaagcacgatgggtggagctggagaaacctctgaagaaacatctggacaaattcgctaatgagcctttgcttttctttggagtcatgttctatgtgccaaatgtgtcatggcttcagcaagaggccacaagatatcagtattacctgcaagtcaaaaaagatgtgcttgaagggcgattacgatgtacattggaccaggtgattcggctagccggcctagctgtgcaagctgattttggagactataatcagtttgattctcaagatttcctcagagagtatgtgctatttcctatggatttggccctggaagaggctgttctggaggagctgacccagaaggtagcccaagaacacaaagcccacaggacaatcatggaaactgtgtacaccttggcattttctttatggggattttcgtgaggaacagaattggaagacaagcggtaatatacaggtggaatgacatggggaatatcactcataacaagtcgaccattctagtggagctcatcaacaaagaagagactgccctctttcacacggatgatatcgaaaatgccaagtatatttctcggttgtttgccacacgacacaagttttacaaacaaaacaaaatctgcactgaacagtcaaattctccaccccccatcagacgccagcccacctggagccgatcctctctgcccaggcagcagccgtacatcctgcctcccgttcacgtccagtgtggtgagcactactcggaaacgcacacctcgcaagacagcatttttcatgggaatgaagaagccttgtattgcaactctcacaacagcctggacttaaattatttaaatggcactgtcaccaatggcagcgtgtgtagcgttcacagcgtcaactccctcaactgctcgcaaagtttcatccaggcctcccctgtatcctccaacctcagtatccctgggagtgacatcatgcgggccgactacatcccgagccaccggcacagcgcgatcatcgtgccctcgtacaggccaacccccgattatgagacagtcatgcgccagatgaagagggggatcctgcatacagacagccagagccagtctctgagaaacctcaacattatcaacacccatgcctacaaccagccagaggatctggtgtacagccaaccggagatgcgggagaggcacccctacactgtcccttatgggccacagggggtctacagcaacaaacttgtcagtccatctgaccagaggaacccaaagaataatgtggtaccaagcaagccgggggcaagcgccatctcgcacacggtgagcaccccagagctggccaacatgcagctgcagggcagccataactacagcacggcccacatgcttaagaactatctcttcaggccaccgcccccctacccacggccacgacctgccaccagcaccccagacctggccagccaccgccacaagtacgtcagcggcagcagcccggacctggtgacccggaaggtgcagctctcggtgaagaccttccaagaggacagctctccggtggttcatcagtctctccaggaggtgagcgagcccctcacggccaccaagcaccacggcactgtgaacaagcgccacagcctggaggtgatgaacagcatggtgcggggcatggaggccatgacgctcaagtcgctccacctccccatggctcgccgcaacacgctccgggagcagggaccgcccgaggaggggtcaggcagccacgaggtcccccagctccctcagtatcaccacaagaagaccttctctgatgccactatgctaatccacagcagcgagagtgaggaggaggaggaggaggctccagaatcggtgccccagatccccatgctccgggagaagatggagtacagtgcccagctgcaggcggccctggcccgcatccccaacaagcccccgcctgagtaccccggtccaaggaagagtgtgagcaatggggctctgaggcaggaccaagccagccttcctcccgccatggccagagccagggtgctgaggcatgggccagccaaggccatcagcatgtctcggactgacccgccggctgtcaacggggcctctctcggcccatccatctcggaacccgacctgactagtgtgaaggagcgggtcaaaaaagagcctgtgaaggagagacctgtgtctgaaatgttttccctggaagacagcattatagagagagagatgatgatcaggaatctagagaagcagaagatggcaggcctggaggcacagaagaggccgctgatgttggcagcattgaatgggctctcggtggctcgagtctcagggcgggaagagaatcgagttgatgccacccgggttcccatggacgagaggttcagaaccctgaagaagaaactagaagagggaatggtgttcacagaatatgagcaaattccaaagaaaaaggcgaatggcattttcagcacagcagctctgccagaaaacgccgagcgcagccgaatccgtgaagttgtcccctatgaggagaatcgagtagagctgataccaaccaaagaaaataacacaggatacattaatgcctcccacatcaaggtggtggttggcggggcagaatggcactacatagccacccaggggcccctgccacacacgtgccacgacttctggcagatggtgtgggagcagggagtgaatgtgattgccatggtcactgcagaggaggagggtggacgaaccaaaagccaccgatactggcccaaactaggttcaaagcacagctcagccacctatggcaagttcaaggtcaccacgaagtttcgaacggattctgtttgctatgcaaccacgggcttgaaggtcaagcaccttttgtctgggcaagaaaggacggtgtggcatttacaatatactgactggccagatcacggctgtccagaagatgtccaaggatttttatcctacttggaggagatccagtcggtccgtcgccataccaacagcatgctggaaggcaccaagaaccggcacccgcccatcgtggtccactgtagtgctggggtgggaaggaccggcgtgctcattctttctgagctgatgatctactgcttggaacataacgaaaaggtggaagtgcccatgatgctgaggctcctcagggagcagaggatgttcatgatccagactatcgctcagtacaagtttgtctaccaagtcctcatccagttcctccaaaactccagactcatt

SEQ ID NO: 24623 - DNA, 3669 bp, Homo sapiens
gaggcaagggcggggactcagtcaccggcctccgcctcccgcggcgtccacactcgccgcgcgcgcggcggccgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccgattca

SEQ ID NO: 24624 - DNA, 2283 bp, Homo sapiens
ggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggtggttatattggcaacctattctcactaagatggggtttatgtcagtcattttggttggcgcttttgttggctggacactgttttttcagcaaaatgccctataaacaattaattttgcccagcaagcttctgcactagtaactgacagtgctacattaatcataggggtttgtctgcagcaaacgcctcatatcccaaaaacggtgcagtagaatagacatcaaccagataagtgatatttacagtcacaagcccaacatctcaggactcttgactgcaggttcctctgaaccccaaactgtaaatggctgtctaaaataaagacattcatgtttgttaaaaactggtaaattttgcaactgtattcatacatgtcaaacacagtatttcacctgaccaacattgagatatcctttatcacaggatttgtttttggaggctatctggattttaacctgcacttgatataagcaataaatattgtggttttatctacgttattggaaagaaaatgacatttaaataatgtgtgtaatgtataatgtactattgacatgggcatcaacacttttattcttaagcatttcagggtaaatatattttataagtatctatttaatcttttgtagttaactgtactttttaagagctcaatttgaaaaatctgttactaaaaaaataaattgtatgtcgattgaattgtactggatacattttccatttttctaaagagaagtttgatatgagcagttagaagttggaataagcaatttctactatatattgcatttcttttatgttttacagttttccccattttaaaaagaaaagcaaacaaagaaacaaaagtttttcctaaaaatatctttgaaggaaaattctccttactgggatagtcaggtaaacagttggtcaagactttgtaaagaaattggtttctgtaaatcccattattgatatgtttatttttcatgaaaatttcaatgtagttggggtagattatgatttaggaagcaaaagtaagaagcagcattttatgattcataatttcagtttactagactgaagttttgaagtaaac

SEQ ID NO: 24625 - DNA, 1706 bp, Homo sapiens
cgcgctcgggcgccgagtctgcgcgctgacgtccgacgctccaggtactttccccacggccgacagggcttggcgtgggggcggggcgcggcgcgcagcgcgcatgcgccgcagcgccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggggagattactttgtattgtactgccattcctactgtatttttatactttttggcagcattaaatatttttgttaaatagtc

SEQ ID NO: 24626 - DNA, 2208 bp, Homo sapiens
tgtcagcaagaatttaggatgtatggaaaggatggtaaaggcaccaactggatggatcagggagacatggaatgcagaatgcaggaaatagatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggtggttatattggcaacctattctcactaagatggggtttatgtcagtcattttggttggcgcttttgttggctggacactgttttttcagcaaaatgccctataaacaattaattttgcccagcaagcttctgcactagtaactgacagtgctacattaatcataggggtttgtctgcagcaaacgcctcatatcccaaaaacggtgcagtagaatagacatcaaccagataagtgatatttacagtcacaagcccaacatctcaggactcttgactgcaggttcctctgaaccccaaactgtaaatggctgtctaaaataaagacattcatgtttgttaaaaactggtaaattttgcaactgtattcatacatgtcaaacacagtatttcacctgaccaacattgagatatcctttatcacaggatttgtttttggaggctatctggattttaacctgcacttgatataagcaataaatattgtggttttatctacgttattggaaagaaaatgacatttaaataatgtgtgtaatgtataatgtactattgacatgggcatcaacacttttattcttaagcatttcagggtaaatatattttataagtatctatttaatcttttgtagttaactgtactttttaagagctcaatttgaaaaatctgttactaaaaaaataaattgtatgtcgattgaattgtactggatacattttccatttttctaaagagaagtttgatatgagcagttagaagttggaataagcaatttctactatatattgcatttcttttatgttttacagttttccccattttaaaaagaaaagcaaacaaagaaacaaaagtttttcctaaaaatatctttgaaggaaaattctccttactgggatagtcaggtaaacagttggtcaagactttgtaaagaaattggtttctgtaaatcccattattgatatgtttatttttcatgaaaatttcaatgtagttggggtagattatgatttaggaagcaaaagtaagaagcagcattttatgattcataatttcagtttactagactgaagttttgaagtaaacacttttcagtttctttctacttcaataaatagtatgattatatgcaaacctt

SEQ ID NO: 24627 - DNA, 1503 bp, Homo sapiens
agcgcgcatgcgccgcagcgccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggggagattactttgtattgtactgccattcctactgtatttttatactttttggcagcattaaatatttttgttaaa

SEQ ID NO: 24628 - DNA, 3654 bp, Homo sapiens
gaagtcagtaaaccacagccttcagcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttctacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatctagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaactga

SEQ ID NO: 24629 - DNA, 2414 bp, Homo sapiens
ggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtcctttgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttg

SEQ ID NO: 24630 - DNA, 5244 bp, Homo sapiens
cggggctgggctcgtggctgagccagcagctgcagcagctacgggagtggccgggtggccggcgggtgccagccgccatggaggccgtgccccgcatgcccatgatctggctggacctgaaggaggccggtgactttcacttccagccagctgtgaagaagtttgtcctgaagaattatggagagaacccagaagcctacaatgaagaactgaagaagctggagttgctcagacagaatgctgtccgtgtcccacgagactttgagggctgtagtgtcctccgcaagtacctcggccagcttcattacctgcagagtcgggtccccatgggctcgggccaggaggccgctgtccctgtcacctggacagagatcttctcaggcaagtctgtggcccatgaggacatcaagtacgagcaggcctgtattctctacaaccttggagcgctgcactccatgctgggggccatggacaagcgggtgtctgaggagggcatgaaggtctcctgtacccatttccagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgacactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaagggccagcctgacactgtgcaagacgcgcttcgcttcactatggatgtcattgggggaaagtacaattctgccaagaaggacaacgacttcatttaccatgaggctgtcccagcattggacactcttcagcctgtaaaaggagcccccttggtgaagcccttgccagtgaaccccacagacccagctgttacaggccctgacatctttgccaaactggtacccatggctgcccacgaggcctcgtcactgtacagtgaggagaaggccaagctgctccgggagatgatggccaagattgaggacaagaatgaggtcctggaccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccaggtccgggctgccctgcccacaccggccctctccccagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccggcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccgccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtggcccgt

SEQ ID NO: 24631 - DNA, 4741 bp, Homo sapiens
aaggggcggggctgggctcgtggctgagccagcagctgcagcagctacgggagtggccgggtggccggcgggtgccagccgccatggaggccgtgccccgcatgcccatgatctggctggacctgaaggaggccggtgactttcacttccagccagctgtgaagaagaatgctgtccgtgtcccacgagactttgagggctgtagtgtcctccgcaagtacctcggccagcttcattacctgcagagtcgggtccccatgggctcgggccaggaggccgctgtccctgtcacctggacagagatcttctcaggcaagtctgtggcccatgaggacatcaagtacgagcaggcctgtattctctacaaccttggagcgctgcactccatgctgggggccatggacaagcgggtgtctgaggagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgacactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaagggccagcctgacactgtgcaagacgcgcttcgcttcactatggatgtcattgggggaaagtacaattctgccaagaaggacaacgacttcatttaccatgaggctgtcccagcattggacactcttcagcctgtaaaaggagcccccttggtgaagcccttgccagtgaaccccacagacccagctgttacaggccctgacatctttgccaaactggtacccatggctgcccacgaggcctcgtcactgtacagtgaggagaaggccaagctgctccgggagatgatggccaagattgaggacaagaatgaggtcctggaccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccaggtccgggctgccctgcccacaccggccctctccccagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccgccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtg

SEQ ID NO: 24632 - DNA, 3135 bp, Homo sapiens
gccggggctggggggtgccaaacccacccggcggctgcgccagcgactctgcagctgaagcgcatttggtgaggcggtcgggcgagggagcgcgcacggagcgcgggacggagcgccaggcggacggaccgaaggacggaggcaccgaaggacggacgcccccgcacacgcagacgcacagagctcggcgcggcccccgtcgcatacacactggcacagacacaagcagggacacacgcagacacacgcacactcgcgcgcgcatcctcccgccagcctgcccgcctgctcgccggcgcccggagcccgctctggccgctggatgatctgaagctgccctctctccttcatttatatcaccagcttgctttttgctgagaaagcttcctgccctggaagatggcacccttccccatccagacaccttgggaatgaattatgagggagccaggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgcttgcctgtggggtgctctggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaactaa

SEQ ID NO: 24633 - DNA, 3037 bp, Homo sapiens
gccggggctggggggtgccaaacccacccggcggctgcgccagcgactctgcagctgaagcgcatttggtgaggcggtcgggcgagggagcgcgcacggagcgcgggacggagcgccaggcggacggaccgaaggacggaggcaccgaaggacggacgcccccgcacacgcagacgcacagagctcggcgcggcccccgtcgcatacacactggcacagacacaagcagggacacacgcagacacacgcacactcgcgcgcgcatcctcccgccagcctgcccgcctgctcgccggcgcccggagcccgctctggccgctggatgatctgaagctgccctctctccttcatttatatcaccagcttgctttttgctgagaaagcttcctgccctggaagatggcacccttccccatccagacaccttgggaatgaattatgagggagccaggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaact

SEQ ID NO: 24634 - DNA, 3088 bp, Homo sapiens
gccggggctggggggtgccaaacccacccggcggctgcgccagcgactctgcagctgaagcgcatttggtgaggcggtcgggcgagggagcgcgcacggagcgcgggacggagcgccaggcggacggaccgaaggacggaggcaccgaaggacggacgcccccgcacacgcagacgcacagagctcggcgcggcccccgtcgcatacacactggcacagacacaagcagggacacacgcagacacacgcacactcgcgcgcgcatcctcccgccagcctgcccgcctgctcgccggcgcccggagcccgctctggccgcttgctttttgctgagaaagcttcctgccctggaagatggcacccttccccatccagacaccttgggaatgaattatgagggagccaggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgcttgcctgtggggtgctctggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaact

SEQ ID NO: 24635 - DNA, 2245 bp, Homo sapiens
gtgctctaaaacgagaagtacaagtgagttcccccaaggggtcggccgcgcctcttcctgtccccgccctgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggttgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcact

SEQ ID NO: 24636 - DNA, 2159 bp, Homo sapiens
attggcctggcaggcaggatcgaggaggaagtggctgattactgagcggttcttcctcacctggcttgggccactgtgcacagctgtgccgctggctcagccccgccccctgcggccctctgccgtggcttccccctccctacagagagatgctgtcccgtgggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggttgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 24637 - DNA, 1971 bp, Homo sapiens
gctgattactgagcggttcttcctcacctggcttgggccactgtgcacagctgtgccgctggctcagccccgccccctgcggccctctgccgtggcttccccctccctacagagagatgctgtcccgtggggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggttgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttct

SEQ ID NO: 24638 - DNA, 2389 bp, Homo sapiens
gctctaaaacgagaagtacaagtgagttcccccaaggggtcggccgcgcctcttcctgtccccgccctgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggttgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaagagcttggagtctagtgcagggaccgtggctgcgtcacctgtgagacggggtggccagaggggactgccagtgccgggtccccctgtgctgtctcctgacctgcaccaactgcctgtacttgcccccctgcacccggctgcagacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 24639 - DNA, 2805 bp, Homo sapiens
gccttctcagccctcaaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgac

SEQ ID NO: 24640 - DNA, 3765 bp, Homo sapiens
aaaaggaggcgtgcagcgagcatgaaccggctgggctgctggcccgcaaggagcctgccaaggtcaggcaggggcagtgggcagaggagtcttggacttgggggccacccttcaggtcccaggcatccaggcaccccagcagcgaagaggacatgggagtcccctggtgtgagggccagagactgtccactgtctgtaagtcttctaagtagatgtcagggttctgggaggaggcctgcagggggctgagggcccaggggaagcccctcggactccctcccacaagtggactctgctatctgcttcctgctgggctggcctacactcaggccgtgggctgtggagagctgggccgtggcacaggcgtggagacgacctttttggcctggccccggccctttccttcacattgtgaggcatggattcttgcttcttctttttccccaccccgagtctgtgccacatctgctctgggaagatgtggtctgtgcttggccatgaattcccaaggcttgaagcagcaagggctttgagggagagggccttgagggagagggccttgagggagagggctgtggggcagaagcagagaaggagaaataagcctccggccaaggtcaggttgagcaggagagccttgggttctttgtgggacagcacagagctgggggtcaggcgagctgtgcccagcaagtaggcagcggctggatgtgacaaagacccagaggagaaacacagaagaggggagagggtctggaagctggggaaagcaggatggtcgggaaggcctggcccctcacccattcccagggaacggggccttgggccccagaagggcacaggcgggaggcagccgacccctggtggcagcggcagcaggcacaggagggcagaatgcagctggggtgtgcgtgggtggcagcaaggaggggcggagggaggaagctggcttcctggagccttctcagccctcaaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgactc

SEQ ID NO: 24641 - DNA, 3265 bp, Homo sapiens
ccagaaacagacctgggagtggaacagcagcagttaggagaggaccctgctggggtccaggagcccgcctgcctggctgcccaaccagctccaacactgctggaggcctccattctctgttcaggggaaggcccactggttagctcagagatggcttctgcgtgctttctcccttccgtcctagagaacacatattttctgtttcctcccttgccttctcccacttggacctgctcagagccctgtgtactctggtgtgtggcctctctcccctctctcttttcctccttctggattctttcctatcttcatccacaatctctaccctttatcttgccgttactctaccccgagactgccttctgccctgggtcccaccaaatagatcctgtccttcccttagtgaaaatgaggccacctcttggggaacagaagacgccccagtgaaaacagagtgcaaacctggcctggcatgggagcctccttctggccaatcaggcaggccagagaacagcagcggagggccctgtctttcaggcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgactc

SEQ ID NO: 24642 - DNA, 542 bp, Homo sapiens
aaagacagaccgacagacagacagacagctggcaagaggcagcctgggggccacagctgcttcacaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacat

SEQ ID NO: 24643 - DNA, 1432 bp, Homo sapiens
aaaaggaggcgtgcagcgagcatgaaccggctgggctgctggcccgcaaggagcctgccaaggtcaggcaggggcagtgggcagaggagtcttggacttgggggccacccttcaggtcccaggcatccaggcaccccagcagcgaagaggacatgggagtcccctggtgtgagggccagagactgtccactgtctacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgt

SEQ ID NO: 24644 - DNA, 551 bp, Homo sapiens
aaagacagaccgacagacagacagacagctggcaagaggcagcctgggggccacagctgcttcaggccctgtctttcaggcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgg

SEQ ID NO: 24645 - DNA, 2689 bp, Homo sapiens
agacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgac

SEQ ID NO: 24646 - DNA, 1189 bp, Homo sapiens
agccctcaaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagagaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaa

SEQ ID NO: 24647 - DNA, 1147 bp, Homo sapiens
aaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatga

SEQ ID NO: 24648 - DNA, 3323 bp, Homo sapiens
agcgaggctgcggcgagtgcggcgctgacagagacgcgcgcgcgcgcgatcgcgctcggaccccggccgctgccgccatcactgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctgtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggctaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctgaggaaa

SEQ ID NO: 24649 - DNA, 3219 bp, Homo sapiens
gcggcccgaaacgccgccgcggagccgaggcggagccgctgtcctcgtccccagcggtcccgcccaacgcccgactctgtgacacaactaaaaaaaaacaaaggtatttatggaattccactgagtggtaatggatgatgcagttcaaataactaaggacacatgttcaaagagcataattaactttttaaaagaagctagacttcttcagaagcttgccagtttttcaagctgatttctctcactggcaactcttcagagtgctgttcctactccaccctcccctggtgataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggctaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctgaggaaa

SEQ ID NO: 24650 - DNA, 3135 bp, Homo sapiens
gtgacacaactaaaaaaaaacaaaggtatttatggaattccactgagtggtaatggatgatgcagttcaaataactaaggacacatgttcaaagagcataattaactttttaaaagaagctagacttcttcagaagcttgccagtttttcaagctgatttctctcactggcaactcttcagagtgctgttcctactccaccctcccctggtgataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggctaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctg

SEQ ID NO: 24651 - DNA, 3343 bp, Homo sapiens
ctgcggcgagtgcggcgctgacagagacgcgcgcgcgcgcgatcgcgctcggaccccggccgctgccgccatcactgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctgtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggcgatttagaaaggctgaattgatgagcaggaatacagagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggctaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctg

SEQ ID NO: 24652 - DNA, 3636 bp, Homo sapiens
ggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggctaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctgaggaaa

SEQ ID NO: 24653 - DNA, 3337 bp, Homo sapiens
ctgcggcgagtgcggcgctgacagagacgcgcgcgcgcgcgatcgcgctcggaccccggccgctgccgccatcactgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctgtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggctaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctg

SEQ ID NO: 24654 - DNA, 749 bp, Homo sapiens
gacgcgcgcgcgcgcgatcgcgctcggaccccggccgctgccgccatcactgtcgcccgcccagtgacacaactaaaaaaaaacaaaggtatttatggaattccactgagtggtaatggatgatgcagttcaaataactaagataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtgg

SEQ ID NO: 24655 - DNA, 2932 bp, Homo sapiens
actgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctgtgacacaactaaaaaaaaacaaaggtatttatggaattccactgagtggtaatggatgatgcagttcaaataactaagataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggctaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccg

SEQ ID NO: 24656 - DNA, 733 bp, Homo sapiens
gcggcccgaaacgccgccgcggagccgaggcggagccgctgtcctcgtccccagcggtcccgcccaacgcccgactctgtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaag

SEQ ID NO: 24657 - DNA, 707 bp, Homo sapiens
agagacgcgcgcgcgcgcgatcgcgctcggaccccggccgctgccgccatcactgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctgacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcag

SEQ ID NO: 24658 - DNA, 1107 bp, Homo sapiens
tgtcggccaaccagcgcctgtctctgaacagccaatgaacacgcgtcttacagccaaggccgggtcgggagcgaggctgcggcgagtgcggcgctgacagagacgcgcgcgcgcgcgatcgcgctcggaccccggccgctgccgccatcactgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaagg

SEQ ID NO: 24659 - DNA, 2338 bp, Homo sapiens
gatcgcgctcggaccccggccgctgccgccatcactgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctgtgacacaactaaaaaaaaacaaaggtatttatggaattccactgagtggtaatggatgatgcagttcaaataactaaggacacatgttcaaagagcataattaactttttaaaagaagctagtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaag

SEQ ID NO: 24660 - DNA, 6110 bp, Homo sapiens
gtctcctctggatcttaactactgagcgcaatgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgcca

SEQ ID NO: 24661 - DNA, 11332 bp, Homo sapiens
ttttttttttccccaagcgaagcatgaacagttgctaagtggaaaatggaggctgaattttacatggtgattcttacctgcttgatcttcaggaactcagaagggtttcagattgtccatgtccagaaacaacagtgtcttttcaaaaatgagaaagtggtcgtgggctcatgcaacaggaccatccagaaccagcagtggatgtggactgaggatgaaaagctccttcatgttaaatctgcactgtgcttggccatctccaactcttcccgcggcccctcccgctcagccatcttggaccgctgttcccaggcaccccgatggacctgctatgatcaggaaggcttccttgaggtggaaaatgcctctctctttctccagaaacaaggctccagagtagtggtcaagaaggccaggaaatacctccatagctggatgaaaatagatgtcaacaaggagggaaaactggtcaatgaaagcctctgtttacaaaaagctggcctgggagcagaagtttcggtgaggagcactagaaacacggctccaccccagattctcactacctttaatgcagttccagatggcctggtattccttattaggaataccacagaggccttcatcagaaatgctgcagaaaactacagccaaaacagcagcgagaggcagcatcccaatctgcacatgactggaattacagacacatcatgggttttgtcgactactcagcccttctccagcaccactgaagagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgtacatagttgtattttgtagtttcttctgtaaatatgtatttttcataatgtttaatattaagctttatataatactatttttccacactaaagtgttcatgacttgttctacataaaactaattcaacctgtatgacaggactactggtaaaatgcatatggaggtggtggcagagacaatccttcaggccatgttttctacctgttttgatattcactggacaggaaaaagggcagggctagagagagcaaatactatggctagatttgctgcattgctgtcccatgaatctcgagagccaacagacatgtcctaacttgctattaggacaaatgtgacagtcaaaaaaaggattagagggagggagaaaaaagaattaagcagtaccaaagctgaactagatgcttgtgtctgaactagttgctctctctctcctttctccttccagggattcaagccaaagtggtcagctcagggatcatgtaacttgcagtgcaagcccaggatggtaggatgcagggttgagggttctgatagagaatgattccaaacagaagtgatgaattccttttgttaataagatgccagctatacccagactggaaacataacatgcaaagcactatctacagtgattagagatcctttcattgcattcatggtgtggagtgtgaacatccacacccatactgtaatgtatttatacacactagtttctgtctcattttcagtggtctccattcctagaaaagtcacaattatccattcctacttgatttcccattaaaagaatattatggtagcagattgtgcccctcattaaaaggcttaatgccaacattttcatagaaatgactacaaacatcatatatagtaaatttaaaaacaatagcaaaaacaaaaacagtggtcttcagtaaaattttcaaaacttcttttagtaaatcaatgaagtcaaaatgtcaagtaatcacccaaagttgcatttaataacaaaaggcactacatactgtaccaagtttatcttcaatatttgtgccttacttactttgactataacaaattccaatgagtcagaaagtatttccttcatcaaggtccagttccgacagcattcctgggaaaaatttgaaaggagtttgtacggaatcttcatagatacctgagaagatgagctggagatgtttgcctttttcacactacaaatttttctgtaataaacttgggaattagaggtcaagtttgttgatggcatagcttcctttgcataaagagtatatttcttttcaaagtatatatttttgtaacctaccataaagtccgtaagtgaatacaacgaatgtaattgacataataattgaaaatcattgactatacctaaaatagttctttataattaaataactctacacccaatctggaaatttttccaaggttatttgaagtttacaaaaatgtgaagcataatcataagcttcaaagattcacagtttcattgtgctcaatgctcttgtgaaatgacagtcttaagctctgattctgtatcaaggaactaagtgaatcttctggaaatgaaaaggaacaacatatgtgtaagtgcagtagatgtaccaccagcgagaaaatagaggtcagagatctacaacgtgtggcatccattagaaatcacctttcctacattgaaaagaaaaaagagaaaaagcagaattttacactaatgttgcttgatgcaaagcacattaatgcttggaaggatacattcattttcgacttttcattcactcagaaaacttctagtaagtatctgcaacctgctaggcactgttccagaatctacacatttctactcacataaagagaatcctcataaagttaggattgttgttactaccttcaattgagcttaaaagacagcctcatcaagggaatgggataactgagccagtctaggacagtggtcaccttccacaggccacacactggaaagtgctaatgctactttaatagcaaacctctggatctaggagagagagcaattaattgcacaaaccaggagttaaaaccataaaaaaaacctatgcatctgtaatagtaaataacactcacgtactctggcaacatctagggtagtatcagaattatgtaaatggacatgacagggaaaaatcgtaggtttttttagtctaatccaacccaggaaatgtttattcctaccctacacctaattttaaaccttcttagcaacaaatatttcactattcgctcctactcctgggaagactaaatatataattgacttatttattaaatttaggagaaaaaaaaagttttccttgacattcagctctattggatttatttccatttaattgcatcatgtgttatgtcttggtaaacactccatttcctgtcttggtgggcatcctgtctgtgtacctgtgcagtacactttaatcatcaagacttcaaagtgcttttgagctatcaaatcttgggagagtcccatctagcatcttaataattatttttccaagttcgttataattaactcctttaacctcatctcattaaatcaattttgtattgtcattctgttgttctctggaaagcagccaattgttcagctcttgaatcagaattttcaaagactcacctctcttacctgggcttgcacatatttgtcctaagtaattctctatcccttaaacctctgagtccctctgttttattacttgccccactcctcctacttgaatatgtttgttttcccagttgaatgtgatttttatctactgttcatattatcttttatacccatgagtataatttcatagtcctttcaggttccacatcatcaaagagatgaccataatttcacttttttttgaaatgaagtcttgctctgttgcccaggctggagtgcagtggcacaatctcagctcactacaacctccgcctcccaggttcaagcgattctgccttagcctcccaagtagctggaattacaggtgcctgccaccatgtctggctaatttttgtgtttttagtagagatggggtttcaccatgttggccaggctggtcttgaactcgtgaccttaggtgatccacccacctcaacctcccaaagtgctaggattacaagagtgagccaccgcacctggccaattcacttttaaatactaaaaggcacacagcacacagacattttcggggcagttttctttgggagggtctttgataaattttgtaatcacctctcggaagaaagcccaaaatgacatgtgaaaataatattaaaccatttaccagatgtccagcaatataaaaatagacctcacatgctacccttcacatgctgattctcttgccttgctgtttaaggatccagtttcttatgttaaacattttccttaccttttgcaataatattattggccatatactaaattctcattcacttagctttctaagaattctttgaggttggaatcctgaaatcataaagctaccagatctgcacaacagcagtggtagtatctgagcccaaactctgagacgctctagagttttagtttacaaacatgagccagaccaaacctgacctggtgaaaatcaataggtaataaactgcttgtatatgatagcagttcaagggctttctgggttccatttcactgaggaaatgaaaatataactgattagccaagacagagtggcaataaggaataactgatcctcctccaagttgcagtgagcaagccctcaagcctacctcattcctgaagagttgaaggagaaaatgccgtgctaattttctgccctgctatttttaacctgaaatttagaattacatcaggtattcaaagaatgttccctatcaaaggaaaatctgtaaacgatgactgcaaaaagcaagtgaaatgatgcaaagagaaaatatttgcaaaacagaatctaaccagacatcatcatgaagataaaatggcatctcttctgtgtggcctgggtgtgcttggacaatcctgtcacacgtttctattaggacatgttgcccttttgaggattcactctatgttggccagatggtttaactgattaaacaattgaatcaatttattttgctttttgaattgaccagatatttaactaaatgtactgggtttggcattttagacacactgccttagattcttgtagtgcatgatgactttgaaaatgtttggccattttagttaaaatgcagggtaacatttgatgcagccatgataacaggaaaaatctgttctgttctaaaaatgtttctagcaatagaagtatttctggctaagagaatactcttgacttgtagggaggctccctcggaataaatgtatgcaacacaaataaggcattttattttttaaaagattgtctatataagatacacttattaaataaagaaattgttggtgaatgctctgaaaa

SEQ ID NO: 24662 - DNA, 10363 bp, Homo sapiens
atgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacattccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggtaatgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgtacatagttgtattttgtagtttcttctgtaaatatgtatttttcataatgtttaatattaagctttatataatactatttttccacactaaagtgttcatgacttgttctacataaaactaattcaacctgtatgacaggactactggtaaaatgcatatggaggtggtggcagagacaatccttcaggccatgttttctacctgttttgatattcactggacaggaaaaagggcagggctagagagagcaaatactatggctagatttgctgcattgctgtcccatgaatctcgagagccaacagacatgtcctaacttgctattaggacaaatgtgacagtcaaaaaaaggattagagggagggagaaaaaagaattaagcagtaccaaagctgaactagatgcttgtgtctgaactagttgctctctctctcctttctccttccagggattcaagccaaagtggtcagctcagggatcatgtaacttgcagtgcaagcccaggatggtaggatgcagggttgagggttctgatagagaatgattccaaacagaagtgatgaattccttttgttaataagatgccagctatacccagactggaaacataacatgcaaagcactatctacagtgattagagatcctttcattgcattcatggtgtggagtgtgaacatccacacccatactgtaatgtatttatacacactagtttctgtctcattttcagtggtctccattcctagaaaagtcacaattatccattcctacttgatttcccattaaaagaatattatggtagcagattgtgcccctcattaaaaggcttaatgccaacattttcatagaaatgactacaaacatcatatatagtaaatttaaaaacaatagcaaaaacaaaaacagtggtcttcagtaaaattttcaaaacttcttttagtaaatcaatgaagtcaaaatgtcaagtaatcacccaaagttgcatttaataacaaaaggcactacatactgtaccaagtttatcttcaatatttgtgccttacttactttgactataacaaattccaatgagtcagaaagtatttccttcatcaaggtccagttccgacagcattcctgggaaaaatttgaaaggagtttgtacggaatcttcatagatacctgagaagatgagctggagatgtttgcctttttcacactacaaatttttctgtaataaacttgggaattagaggtcaagtttgttgatggcatagcttcctttgcataaagagtatatttcttttcaaagtatatatttttgtaacctaccataaagtccgtaagtgaatacaacgaatgtaattgacataataattgaaaatcattgactatacctaaaatagttctttataattaaataactctacacccaatctggaaatttttccaaggttatttgaagtttacaaaaatgtgaagcataatcataagcttcaaagattcacagtttcattgtgctcaatgctcttgtgaaatgacagtcttaagctctgattctgtatcaaggaactaagtgaatcttctggaaatgaaaaggaacaacatatgtgtaagtgcagtagatgtaccaccagcgagaaaatagaggtcagagatctacaacgtgtggcatccattagaaatcacctttcctacattgaaaagaaaaaagagaaaaagcagaattttacactaatgttgcttgatgcaaagcacattaatgcttggaaggatacattcattttcgacttttcattcactcagaaaacttctagtaagtatctgcaacctgctaggcactgttccagaatctacacatttctactcacataaagagaatcctcataaagttaggattgttgttactaccttcaattgagcttaaaagacagcctcatcaagggaatgggataactgagccagtctaggacagtggtcaccttccacaggccacacactggaaagtgctaatgctactttaatagcaaacctctggatctaggagagagagcaattaattgcacaaaccaggagttaaaaccataaaaaaaacctatgcatctgtaatagtaaataacactcacgtactctggcaacatctagggtagtatcagaattatgtaaatggacatgacagggaaaaatcgtaggtttttttagtctaatccaacccaggaaatgtttattcctaccctacacctaattttaaaccttcttagcaacaaatatttcactattcgctcctactcctgggaagactaaatatataattgacttatttattaaatttaggagaaaaaaaaagttttccttgacattcagctctattggatttatttccatttaattgcatcatgtgttatgtcttggtaaacactccatttcctgtcttggtgggcatcctgtctgtgtacctgtgcagtacactttaatcatcaagacttcaaagtgcttttgagctatcaaatcttgggagagtcccatctagcatcttaataattatttttccaagttcgttataattaactcctttaacctcatctcattaaatcaattttgtattgtcattctgttgttctctggaaagcagccaattgttcagctcttgaatcagaattttcaaagactcacctctcttacctgggcttgcacatatttgtcctaagtaattctctatcccttaaacctctgagtccctctgttttattacttgccccactcctcctacttgaatatgtttgttttcccagttgaatgtgatttttatctactgttcatattatcttttatacccatgagtataatttcatagtcctttcaggttccacatcatcaaagagatgaccataatttcacttttttttgaaatgaagtcttgctctgttgcccaggctggagtgcagtggcacaatctcagctcactacaacctccgcctcccaggttcaagcgattctgccttagcctcccaagtagctggaattacaggtgcctgccaccatgtctggctaatttttgtgtttttagtagagatggggtttcaccatgttggccaggctggtcttgaactcgtgaccttaggtgatccacccacctcaacctcccaaagtgctaggattacaagagtgagccaccgcacctggccaattcacttttaaatactaaaaggcacacagcacacagacattttcggggcagttttctttgggagggtctttgataaattttgtaatcacctctcggaagaaagcccaaaatgacatgtgaaaataatattaaaccatttaccagatgtccagcaatataaaaatagacctcacatgctacccttcacatgctgattctcttgccttgctgtttaaggatccagtttcttatgttaaacattttccttaccttttgcaataatattattggccatatactaaattctcattcacttagctttctaagaattctttgaggttggaatcctgaaatcataaagctaccagatctgcacaacagcagtggtagtatctgagcccaaactctgagacgctctagagttttagtttacaaacatgagccagaccaaacctgacctggtgaaaatcaataggtaataaactgcttgtatatgatagcagttcaagggctttctgggttccatttcactgaggaaatgaaaatataactgattagccaagacagagtggcaataaggaataactgatcctcctccaagttgcagtgagcaagccctcaagcctacctcattcctgaagagttgaaggagaaaatgccgtgctaattttctgccctgctatttttaacctgaaatttagaattacatcaggtattcaaagaatgttccctatcaaaggaaaatctgtaaacgatgactgcaaaaagcaagtgaaatgatgcaaagagaaaatatttgcaaaacagaatctaaccagacatcatcatgaagataaaatggcatctcttctgtgtggcctgggtgtgcttggacaatcctgtcacacgtttctattaggacatgttgcccttttgaggattcactctatgttggccagatggtttaactgattaaacaattgaatcaatttattttgctttttgaattgaccagatatttaactaaatgtactgggtttggcattttagacacactgccttagattcttgtagtgcatgatgactttgaaaatgtttggccattttagttaaaatgcagggtaacatttgatgcagccatgataacaggaaaaatctgttctgttctaaaaatgtttctagcaatagaagtatttctggctaagagaatactcttgacttgtagggaggctccctcggaataaatgtatgcaacacaaataaggcattttattttttaaaagattgtctatataagatacacttattaaataaagaaattgttggtgaatgctctgaaaa

SEQ ID NO: 24663 - DNA, 6581 bp, Homo sapiens
aagcatgaacagttgctaagtggaaaatggaggctgaattttacatggtgattcttacctgcttgatcttcaggaactcagaagggtttcagattgtccatgtccagaaacaacagtgtcttttcaaaaatgagaaagtggtcgtgggctcatgcaacaggaccatccagaaccagcagtggatgtggactgaggatgaaaagctccttcatgttaaatctgcactgtgcttggccatctccaactcttcccgcggcccctcccgctcagccatcttggaccgctgttcccaggcaccccgatggacctgctatgatcaggaaggcttccttgaggtggaaaatgcctctctctttctccagaaacaaggctccagagtagtggtcaagaaggccaggaaatacctccatagctggatgaaaatagatgtcaacaaggagggaaaactggtcaatgaaagcctctgtttacaaaaagctggcctgggagcagaagtttcggtgaggagcactagaaacacggctccaccccagattctcactacctttaatgcagttccagatggcctggtattccttattaggaataccacagaggccttcatcagaaatgctgcagaaaactacagccaaaacagcagcgagaggcagcatcccaatctgcacatgactggaattacagacacatcatgggttttgtcgactactcagcccttctccagcaccactgaagagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgt

SEQ ID NO: 24664 - DNA, 5839 bp, Homo sapiens
tctcctctggatcttaactactgagcgcaatgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacattccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgcca

SEQ ID NO: 24665 - DNA, 1292 bp, Homo sapiens
aaattctctttctaaaagccaggctgacctgctgctgcaagggtggggctgagaagtctggaaacctggagacagaggatgtcacaggagtcacacatgtgcagaaggtctgggggcagtgagcagccccacaggcattgctcccctggattgtcaggcagggaaactgaggcagaagacctgagaacacatgcaaggctgcatccagcttcaagttggtgctgcttcttccttggaggacaggcccggcagcccagcctcctccagagagactggggagggtctggtgtggaccaggggtcctgcagcagggaggggcaggtggggtatgtgggcaggaagcggaagcctgggccacccttcactgcagacgagcactgagctcacttctcgctcgacacagccagagctggaggtgggtgcccggcacggaggggcctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtg

SEQ ID NO: 24666 - DNA, 7882 bp, Homo sapiens
gctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagtttctgtctgtgcaacttaccatacaggagcccttcagattgagcagagtgaagagtctgaccaaggaaaatatgagtgtgttgccaccaacagcgcgggcactcgctattccgctcctgccaatttatatgtcagagtaaatagaaaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaagtaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgc

SEQ ID NO: 24667 - DNA, 8251 bp, Homo sapiens
gctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaatgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaagcagtaaacccgacaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgc

SEQ ID NO: 24668 - DNA, 9472 bp, Homo sapiens
caggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgc

SEQ ID NO: 24669 - DNA, 9403 bp, Homo sapiens
gctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcaggagcccttcagattgagcagagtgaagagtctgaccaaggaaaatatgagtgtgttgccaccaacagcgcgggcactcgctattccgctcctgccaatttatatgtcagagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacaggacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgc

SEQ ID NO: 24670 - DNA, 9430 bp, Homo sapiens
gctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcaggagcccttcagattgagcagagtgaagagtctgaccaaggaaaatatgagtgtgttgccaccaacagcgcgggcactcgctattccgctcctgccaatttatatgtcagagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgc

SEQ ID NO: 24671 - DNA, 10123 bp, Homo sapiens
gcagtttattctgggcctgtgtggaatagaaagacaattctttatttgactggtaggaaagaaaagagaagactcctcagggtttccaaggaggactggagcggctgctttattaatgtaaaataatggatctagcccaatgtcctcatttttgcaggtgaagaagtgaagaatcaaggaagtaaaggacctgtctcaaagtcacacaactaggaaatcttgaggagtctgatacttttcatcctccagctataaaatcatcttgtagggggaagctgtacattggtggaaaataaaaggcaagcagttcctggcccgtgatattccagttagaggtgtctgactgacagcatgttggcaccgagggaagcgatgggcttcggctccaggtttctgtcctgagaccacagcagaatgtgccttggacaaaggcttggactccttgatcttctggtaacttcaaaaatctggtctcagggtggtgaactttttcttcgaattcctaacctgtgagcttacgatgatggtgcctgtccattaactgaacaactgtggttttgaacttcttgaggccagggactgtgtctgaaaacaccgacggtggctaactcaagggagacgtctggtgaacacccgtgggatctaaagaacaagctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgca

SEQ ID NO: 24672 - DNA, 8239 bp, Homo sapiens
gctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcaggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaatgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaagtaaacccgacaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgc

SEQ ID NO: 24673 - DNA, 8248 bp, Homo sapiens
gctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagtatccataggagcccttcagattgagcagagtgaagagtctgaccaaggaaaatatgagtgtgttgccaccaacagcgcgggcactcgctattccgctcctgccaatttatatgtcagagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaatgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggttcagatgattccggttaccctggtaaccttcattcttcaagtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgc

SEQ ID NO: 24674 - DNA, 521 bp, Homo sapiens
gcggccgctgctccgcgggattaaattggccgcccggaggcggcggcgcggccgtggcggggcgcgaaggcgctggaggaaagtgttggcggcggcgcgggaggcggtggcggcggctgcccggggccaacatgaccaggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgag

SEQ ID NO: 24675 - DNA, 5039 bp, Homo sapiens
ccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaatgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaagtaaacccgacaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggag

SEQ ID NO: 24676 - DNA, 8239 bp, Homo sapiens
gctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcaggtagggtcttccatacaggagcccttcagattgagcagagtgaagagtctgaccaaggaaaatatgagtgtgttgccaccaacagcgcgggcactcgctattccgctcctgccaatttatatgtcagagtaaatagaaaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaatgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaagaaaaccctataggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgc

SEQ ID NO: 24677 - DNA, 6210 bp, Homo sapiens
caggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaaggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaatttt

SEQ ID NO: 24678 - DNA, 5331 bp, Homo sapiens
agccggagctggagccgaggcggcggcgggacgcggccggccggacaaatttcctgctaggctgcggacagcgggcggcaggagccggcgcgagcggcttcaggaacccacggcctctgcgcgtccccgcgacccttcttcgcgcccggcgaagacagccgggcgccccggagggcggcgggcaggcgcccgggagatgcggagcctccgctgcagcgcgatctgcgcgaccagaccggcccccccgagactatagccttcactttccctcggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcagaagtcagttcgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaagactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 24679 - DNA, 4957 bp, Homo sapiens
gtgcagcagagggcagctgagaggctgggtggctgggcctgggagacacacagaggccaggccttagcgcggctcagccatgagcaacaggagtagcttttcccggctcacctggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcagaagtcagttcgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaagactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 24680 - DNA, 2293 bp, Homo sapiens
acagcagacccagttcaaagttggaattcttctagaaatcctttctcagctgtcagggaaacatggattctccaaggccaggatggtttcccagcgtcttcccaggaagacaagaggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggaacaaaggagaagccactttccccaggacgca

SEQ ID NO: 24681 - DNA, 928 bp, Homo sapiens
agaaatcctttctcagctgtcagggaaacatggattctccaaggccaggatggtttcccagcgtcttcccaggaagacaagaggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaacatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccc

SEQ ID NO: 24682 - DNA, 2189 bp, Homo sapiens
acagcagacccagttcaaagttggaattcttctagaaatcctttctcagctgtcagggaaacatggattctccaaggccaggatggtttcccagcgtcttcccaggaagacaagaggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcaggaacagtatgaattctgctacaaagtggtacaagattttattgatatattttctgattatgctaatttcaaatgaagattcctgccttaaaatattttttaatttaatggaacaaaggagaagccactttccccaggacgcaagactctcccctccactgtccgggacagcgttcgccctttagcggggaggtcattacagcctcatggcctctaccaaggccccagatcacaggatctcctgggccttggagcacctcacgctgggggaatcaatccctg

SEQ ID NO: 24683 - DNA, 779 bp, Homo sapiens
gagcggcttcaggaacccacggcctctgcgcgtccccgcgacccttcttcgcgcccggcgaagacagccgggcgccccggagggcggcgggcaggcgcccgggagatgcggagcctccgctgcagcgcgatctgcgcgaccagaccggcccccccgagtaagcgcttgcagccagttgtctagttgtcagaagccgagctcatcagcgggctcctggtgtcggcgttctgctgctggaaggtcagggagttccctggaccccacggaagaagctgtctccatgaaggacagggaccgtgccgtgaaccttttattctcccactgacatgactatagccttcactttccctcggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaac

SEQ ID NO: 24684 - DNA, 2304 bp, Homo sapiens
atctcaaatcctgttgcagtcagtagcgctggctgtctgcagtagagatggttttcaatgattgtttcagaaattccttatcaacagaaaatgaacgagacggggagttttcagaaaataaatggatttgcagacaacttaacgtcatcatcgaagtcaccaaagaaagcaaagcagcgactggggaagctgaggctgaagtagcaagggcatgccacccaggctgctattccagtcgctgtgaaagcctggtcactgtctttgccacgcagaacacatctctgggaatgctgtcgatctatgcctccatcttttaaaggctttccatttctgtctggattttttctttatgggaggcagaaataatagtgaattgaatgaaatggagtatataagtgtctagcacagtccttggcacatagaaagtgctctgtaaacagtacttcgcatcaaattcttgggatgaatgaaagtgagtgcctggcgctgcacataagaaaagacgtggcagcaaaccatcctcccgacatgacgtgctgcgttggtgcgtttacgtccctgttccttctgaaagactcaaaattgtgttggagctactggtgcacctttgtaagacctgcactaacgaccgcgccactgggaagggcacttctttatgaagtcgccgtattcccagggagactggtcaacccatacaatgtgaaaaaaaaagaagctatgtgaaaaaatattcccctttgtcatagagaaggagaacttggtgaggctgggcagctgcaggagcctcagtttttcagataacagaacagagtagaccttgagggtccatttccctttttgttttaggaagtgctgtagaagggggcaaagagatctttgatatgagaaggtatttcttcaaagcagcatcgtgcctgaaatagcattgttctttacgctgagagaggaggaaatgggaatttggtgttcaacgggtttaaagtttcagttacaagaaatggacaagtccgagagctctgctgtgccacatcatgcctaaagtcaccgagactgtgttgtacacttttttgttaaaaggtaaatctcatgttaaatgttgttactacaattaaaaagaagccctaggctgtgtttgcagaaaggcactaaccatacatgtgctcaagagcccttttgtgttttcttcacttcatgttgtagttcaatttagttttgctttgcaaggatcctcggaaagtgtatcatcagcaatgacttttattttagaactaaatgtgaaccacggggggaatcatgatcgacattgctcgttgtcctttcttcctccctgtgggctgtgaatccaactcgtcctgggagcagggcgctctcgccttctgttcctctccgagctcagtgcacagaagcattctgcttacccagctgggactgctgactgcaccatcgagcacgcaggttgcactgttctcagcagctacactggattatatgccgcctttcttactgactgattatgaacttaaaacaaattcactctgctgctgtgaattatacatttatttttaagcatttatttcaactcgagatgagcggtctctcctgtaaatttctccctgctggatctttgctctggtttctggtgacatagtgtgagtgccggcagccgcgagcctcagaaggaaaattacaaagggaatactcagtaaatgatgtattgcctttcgcatcagtagcctgcttggaaatgttcaaattatcagcccaggagactccagtgctgtggacatgggtctgaacgaattgatcacctaggggctactgagaacgcggtgctctgtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggc

SEQ ID NO: 24685 - DNA, 7727 bp, Homo sapiens
cgggagcggcgggagcggtggcggcggcagaggcggcggctccagcttcggctccggctcgggctcgggctccggctccggctccggctccggctccagctcgggtggcggtggcgggagcgggaccaggtggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccagtggcggccagaggagtccgaggactatgaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtgcccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 24686 - DNA, 7412 bp, Homo sapiens
ggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtgcccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaaccagga

SEQ ID NO: 24687 - DNA, 7439 bp, Homo sapiens
ggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccagtggcggccagaggagtccgaggactatgaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtgcccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaaccagga

SEQ ID NO: 24688 - DNA, 4836 bp, Homo sapiens
cagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccatgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtgcccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggttccagtgtccccagttgcccgaatacctcaagtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggtt

SEQ ID NO: 24689 - DNA, 6377 bp, Homo sapiens
gcggtggcggcggcagaggcggcggctccagcttcggctccggctcgggctcgggctccggctccggctccggctccggctccagctcgggtggcggtggcgggagcgggaccaggtggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtgcccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagg

SEQ ID NO: 24690 - DNA, 5234 bp, Homo sapiens
gccgcgcagccgggcccgctcctcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgccaatgaa

SEQ ID NO: 24691 - DNA, 4133 bp, Homo sapiens
gctcctcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggtatgtgatgggtcacactaacctgtcacttgttgggagcatgagcagctttctgtctggaacattaataatgatctaaaacggcctatttaatatgttacaaggcacttgagtatggttgcatgtccaaatataaatgtttttaaattaactctaacatttgtttataaaagtttaaccataataatagaatttttaaaacacgcttgtctggttgaatcttagcatatttttccaactaataaagctcagtattcgtctgtgttctcagagagagactgaggcatacttgtaaatttgtgtctgtgacaggccgtgctagaaagctctttcaggaaatagtagtgtagtagtagcttccaaaccacataatttactgctctcc

SEQ ID NO: 24692 - DNA, 575 bp, Homo sapiens
tcaacggtcctcaccccccggggttcggggcttccgccgcacctgatacaggaggggaggagtgcggctcgagcaggctggaggtcaccatccccatcagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtgg

SEQ ID NO: 24693 - DNA, 563 bp, Homo sapiens
ggcttgcccttttttgtgagggtagtcctttgggatcttgaccccttccctggatttttgtctgtgttaatgtcttcatgttgtgtatttttgcacttaatatttgccctgtgtatgttttcccagcttatttacacacaaagcataacagatctgagcataatgagactgcccatctttttagctacagatacctgtaaagttgcatatttgtgggaacctgtattctgagcttaattactgtagcctgggtctttcatttcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgta

SEQ ID NO: 24694 - DNA, 5241 bp, Homo sapiens
gctcctcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttcctagtgatttaaggaaacatcgtagaaagttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgcc

SEQ ID NO: 24695 - DNA, 4716 bp, Homo sapiens
gtgggatttggggggcgctggtgggcacccctggatctggcggctgcggcctcgcggggggaggctgatcggtgacaggggcagggggctattttgggggtagaaggcagtgagagcgtgagggggaggggggtccccagcgcccaagccggagccagagacgcggagcccgcgcgagcgtcggagacagggctccagggctccgaagcgacagagccgggccccggccgctgccaggggccccgcccggcccccccactccaccccacgtccctcctgcagcccagctccgcccgcagccgccgcggaccaggcaggcccgcaccgccgccatgatgtgcgaggtgatgcccaccatcagcgaggatggccggcggggctcggcgctgggcccggacgaggcgggcggggagctggagcgcctcatggtcacgatgctcacggagcgcgagcgcctgctggagacgctgcgcgaggcacaggacgggttggctacagcgcagctgcggctgcgcgagctcggccacgagaaggactcgctgcagcgccagctcagcatcgcgctgccccaggagtttgcagctctgacgaaggagctgaacttatgtcgggagcagctgctggagagggaggaagagattgcagagctgaaggcggaacggaacaacacgcggctgctcctggaacacctggagtgcctggtgtccaggcacgagaggtcactgcgcatgaccgtggtgaagcgccaggcccagtccccgggtggggtctcctcggaggtagaagtgctcaaagctctaaagtctctcttcgagcaccacaaggccctggatgagaaggtccgggagcggctgcggatggcgctggagcgcgtggcagtgctcgaggaggagctggaactgagcaatcaggagactctgaaccttcgagaacagctgtctaggcggcggtcagggctggaagagccgggcaaggatggggatgggcagactcttgccaatggcctgggtcctggcggggattccaaccggcgcacagcagagctggaggaggccctggagcggcagcgcgccgaggtgtgccagctgcgggagcgcctggcggtgctgtgccgtcagatgagccagctggaggaggagttgggcaccgcgcaccgtgagctgggcaaggcagaggaagccaactccaagctgcagcgcgacctcaaggaggcgctggcgcagcgggaagatatggaggagcggattacaacactggagaagcgctacctgagcgcccagcgggaggccacgtctctgcacgacgccaacgacaaactggagaacgagttagctagcaaggagtcgttgtatcggcagagtgaagagaagagccgtcagctggccgagtggttggacgacgccaagcagaagctgcagcagacgctgcagaaagcggagaccttgcccgagatagaggcgcagctggcgcagcgcgtggcggcgctcaacaaggccgaggaacgtcatgggaattttgaggagcggcttcggcagctggaggcccagctggaagagaagaatcaagagctgcagcgggcccggcagcgggagaagatgaacgatgaccacaataagcggctgtccgagacggtggacaagctgctgagcgagtccaacgagcgcttacagcttcacctcaaggagcgcatgggggcgctggaggagaagaactccctgagcgaggagatagccaacatgaagaagcttcaggatgagttgctgctaaacaaggagcagctcttggccgaaatggagcggatgcagatggagatcgaccagctgcgggggaggccaccatcctcctactccaggtctctccctggcagtgccctggagctccgttactctcaggcacccactttaccttctggtgcccacctggatccctatgtggctggcagtggtcgggcaggcaagaggggccgctggtcaggggtcaaggaggagccctccaaggattgggagcggtctgcccctgcgggctccataccacccccattccctggggaactggacggctccgatgaggaggaggcagaggggatgtttggggccgagctgctgtcccccagtgggcaggctgacgtgcagacgctggccatcatgcttcaggagcagctggaggccatcaacaaggagatcaagctgatccaagaggagaaggagacaacagaacagagggcagaggagctggagagtcgggtgtccagctctggcttggactcgttgggccgctaccgcagcagctgctccctgcccccctccctcaccacctctacccttgccagcccctcccctcccagctctggccactcaacaccccgcctggcaccccctagccctgcccgtgagggcaccgacaaggctaatcatgtccctaaggaggaagctggagctccacgaggggaggggccggccatcccaggagacaccccaccacccactccccgctctgcccgtcttgagagaatgacccaggccttggcactgcaggcggggtccctggaagatgggggacccccacggggaagtgagggcaccccagattctctgcacaaagcccccaagaagaagagcatcaagtcatccataggccgtctctttggcaagaaagagaagggacgaatgggacccccaggccgggacagctcttctctggctggaacaccctcagatgagacactggccactgaccctctggggctagccaagctgacaggcccaggagacaaggaccgaaggaacaagaggaagcatgaactcctggaggaggcctgccgccagggcctaccttttgctgcctgggacgggcccaccgtggtgtcctggctggagctgtgggtgggcatgcctgcctggtatgtggccgcctgccgggccaatgtcaagagcggtgccatcatggccaacctgtcagacacggagatccagcgcgagatcggcatcagcaacccgctgcaccgactcaagctacgcctcgccatccaggagatggtctcgctcacctcgccctcagcccccgcctcctcccgcacttccacaggaaacgtgtggatgacacacgaggagatggagtcccttacggccacgaccaagcccgagaccaaggagatcagctgggagcagatcctggcatatggcgacatgaaccacgagtgggtggggaacgactggctgcccagcctggggctgccccaataccgcagctacttcatggagtcgctggtggacgctcgaatgttagatcaccttaacaagaaggagctccggggccaactcaagatggtggacagctttcacagggtgagtctacattatgggattatgtgcctgaaacggctcaactatgaccggaaggacctggagcggaggcgggaagaaagtcagacccagatccgagacgtgatggtgtggtccaatgagcgggtcatgggttgggtgtccgggctgggcctgaaggaatttgccacgaacctcacggagagcggggtacacggggcactgctcgccctggacgagaccttcgactactccgacctggccttgctcctgcagatccccacgcagaatgcacaggcccggcagcttctggagaaggaattcagcaaccttatctccttaggcacagacaggcggctggacgaggacagcgccaagtctttcagccgctccccatcctggcggaagatgttccgggagaaggacctccgaggcgtaactcccgactcagctgagatgttgccccccaactttcgttcggctgcagcgggagccctgggctctccggggctccctctccgcaagctgcagccagaaggccagacttctgggagttcccgggcagacggcgtttcggtccggacctattcctgctagtgcaggcctccaggtgacctcactcggacggaagaatcttcccgaggctgggctgttccctctcctgcccggactgtggcctcgccggggagagcgggcgggggagctcgcgccgaggactggaccatctgtacagaccagcgggagtgcgcgcgcccgcctcgcacagggccggggcctggaccaaaccacatgaactggactgagagggggaagaagcggggaggaagaaatcccgccccaaacgtccgctttccttttctctactttgtaatttattgatcagtttctgttgggagacgggtgtcctttacccgcgggaagggggcggggcttccctcccgggccgcatgcggggagaggctgctccctcccctttttcctgcccagtcgcggggcccaagtcttccttcttcgtccgaaaggaggggaggggggactcgctgctacaagcctcgccccctgtgccactcagctccgccccgccgcgtccggtcgccggtcccccgggtcatctgcgggcgggttcccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatgccgctgggcgacgtggcgtgggggcagggggacggtgggggagccctcgcccccgactctcggtcggcctccccgccccaggcgtcactcagtgatcacgggtaaagagaactgtttc

SEQ ID NO: 24696 - DNA, 2236 bp, Homo sapiens
gattgagccgaatgtccagatcctgccaatgtctggacaggagtttgcagctctgacgaaggagctgaacttatgtcgggagcagctgctggagagggaggaagagattgcagagctgaaggcggaacggaacaacacgcggctgctcctggaacacctggagtgcctggtgtccaggcacgagaggtcactgcgcatgaccgtggtgaagcgccaggcccagtccccgggtggggtctcctcggaggtagaagtgctcaaagctctaaagtctctcttcgagcaccacaaggccctggatgagaaggtccgggagcggctgcggatggcgctggagcgcgtggcagtgctcgaggaggagctggaactgagcaatcaggagactctgaaccttcgagaacagctgtctaggcggcggtcagggctggaagagccgggcaaggatggggatgggcagactcttgccaatggcctgggtcctggcggggattccaaccggcgcacagcagagctggaggaggccctggagcggcagcgcgccgaggtgtgccagctgcgggagcgcctggcggtgctgtgccgtcagatgagccagctggaggaggagttgggcaccgcgcaccgtgagctgggcaaggcagaggaagccaactccaagctgcagcgcgacctcaaggaggcgctggcgcagcgggaagatatggaggagcggattacaacactggagaagcgctacctgagcgcccagcgggaggccacgtctctgcacgacgccaacgacaaactggagaacgagttagctagcaaggagtcgttgtatcggcagagtgaagagaagagccgtcagctggccgagtggttggacgacgccaagcagaagctgcagcagacgctgcagaaagcggagaccttgcccgagatagaggcgcagctggcgcagcgcgtggcggcgctcaacaaggccgaggaacgtcatgggaattttgaggagcggcttcggcagctggaggcccagctggaagagaagaatcaagagctgcagcgggcccggcagcgggagaagatgaacgatgaccacaataagcggctgtccgagacggtggacaagctgctgagcgagtccaacgagcgcttacagcttcacctcaaggagcgcatgggggcgctggaggagaagaactccctgagcgaggagatagccaacatgaagaagcttcaggatgagttgctgctaaacaaggagcagctcttggccgaaatggagcggatgcagatggagatcgaccagctgcgggggaggccaccatcctcctactccaggtctctccctggcagtgccctggagctccgttactctcaggcacccactttaccttctggtgcccacctggatccctatgtggctggcagtggtcgggcaggcaagaggggccgctggtcaggggtcaaggaggagccctccaaggattgggagcggtctgcccctgcgggctccataccacccccattccctggggaactggacggctccgatgaggaggaggcagaggggatgtttggggccgagctgctgtcccccagtgggcaggctgacgtgcagacgctggccatcatgcttcaggagcagctggaggccatcaacaaggagatcaaaatcatgtccctaaggaggaagctggagctccacgaggggaggggccggccatcccaggagacaccccaccacccactccccgctctgcccgtcttgagagaatgacccaggccttggcactgcaggcggggtccctggaagatgggggacccccacggggaagtgagggcaccccagattctctgcacaaagcccccaagaagaagagcatcaagtcatccataggccgtctctttggcaagaaagagaagggacgaatgggacccccaggccgggacagctcttctctggctggaacaccctcagatgagacactggccactgaccctctggggctagccaagctgacaggcccaggagacaaggaccgaaggaacaagaggaagcatgaactcctggaggaggcctgccgccagggcctaccttttgctgcctgggacgggcccaccgtggtgtcctggctggagctgtgggtgggcatgcctgcctggtatgtggccgcctgccgggccaatgtcaagagcggtgccatcatggccaacctgtcagacacggagatccagcgcgagatcggcatcagca

SEQ ID NO: 24697 - DNA, 9021 bp, Homo sapiens
ctcaagttggggatcctcggctgctcgccgccgccgcccgcggtccctgcctgccccaggcccggggcatcgccgccggccgccgactccgcgccctgcccgatcggctctctcctttttaaacggaaagcagcctttctccgccgagaggatcgtccccagcgtggctctgcgttcccggtcactttttgagattttccggggggcgctcggcggcttcccggattccaaggggactcgggccgccgagcgcggggggcccgtggagcgggcgagccggggaagcgccccggcttagcggaggctcgcacggaggcaagaacttattcaacaagtttacctccctgctttcctcttttcgatgtgcgttttcggacatgcggaggttactggaaccgtgttggtggattttgttcctgaaaatcaccagttccgtgctccattatgtcgtgtgcttccccgcgttgacagaaggctacgttggggccctgcacgagaatagacacggcagcgcagtgcagatccgcaggcgcaaggcttcaggcgacccgtactgggcctactctggtgcctatggtcctgagcactgggtcacgtctagtgtcagctgtgggggccgtcaccagtctcctattgacattttagaccagtatgcgcgtgttggggaagaataccaggaactgcaactcgatggcttcgacaatgagtcttctaacaaaacctggatgaaaaacacagggaaaacagtcgccatccttctgaaagacgactattttgtcagtggagctggtctacctggcagattcaaagctgagaaggtggaatttcactggggccacagcaatggctcagcgggctctgaacacagcatcaatggcaggaggtttcctgttgagatgcagattttcttttacaatccagatgactttgacagctttcaaaccgcaatttctgagaacagaataatcggagccatggccatattttttcaagtcagtccgagggacaattctgcactggatcctattatccacgggttgaagggtgtcgtacatcatgagaaggagacctttctggatcctttcgtcctccgggacctcctgcctgcatccctgggcagctattatcggtacacaggttccttgaccacaccaccgtgtagcgaaatagtggagtggatagtcttccggagacccgtccccatctcttaccatcagcttgaggctttttattccatcttcaccacggagcagcaagaccatgtcaagtcggtggagtatctgagaaataactttcgaccacagcagcgtctgcatgacagggtggtgtccaagtccgccgtccgtgactcctggaaccacgacatgacagacttcttagaaaacccactggggacagaagcctctaaagtttgcagctctccacccatccacatgaaggtgcagcctctgaaccagacggcactgcaggtgtcctggagccagccggagactatctaccacccacccatcatgaactacatgatctcctacagctggaccaagaatgaggacgagaaggagaagacgtttacaaaggacagcgacaaagacttgaaagccaccattagccatgtctcacccgatagcctttacctgttccgagtccaggccgtgtgtcggaacgacatgcgcagcgactttagccagacgatgctgtttcaagctaataccactcgaatattccaagggaccagaatagtgaaaacaggagtgcccacagcgtctcctgcctcttcagccgacatggcccccatcagctcggggtcttctacctggacgtcctctggcatcccattctcatttgtttccatggcaactgggatgggcccctcctccagtggcagccaggccacagtggcctcggtggtcaccagcacgctgctcgccggcctggggttcggcggtggtggcatctcctctttccccagcactgtgtggcccacgcgcctcccgacggccgcctcagccagcaagcaggcggctaggccagtcctagccaccacagaggccttggcttctccagggcccgatggtgattcgtcaccaaccaaggacggcgagggcaccgaggaaggagagaaggatgagaaaagcgagagtgaggatggggagcgggagcacgaggaggatggagagaaggactccgaaaagaaggagaagagtggggtgacccacgctgccgaggagcggaatcagacggagcccagccccacaccctcgtctcctaacaggactgccgagggagggcatcagactatacctgggcatgagcaggatcacactgccgtccccacagaccagacgggcggaaggagggatgccggcccaggcctggaccccgacatggtcacctccacccaagtgccccccaccgccacagaggagcagtatgcagggagtgatcccaagaggcccgaaatgccatctaaaaagcctatgtcccgcggggaccgattttctgaagacagcagatttatcactgttaatccagcggaaaaaaacacctctggaatgataagccgccctgctccagggaggatggagtggatcatccctctgattgtggtatcagccttgaccttcgtgtgcctcatccttctcattgctgtgctcgtttactggagagggtgtaacaaaataaagtccaagggctttcccagacgtttccgtgaagtgccttcttctggggagagaggagagaaggggagcagaaaatgttttcagactgctcatttctatgtggaagacagcagttcacctcgagtggtccctaatgaaagtatccctattattcctattccggatgacatggaagccattcctgtcaaacagtttgtcaaacacatcggtgagctctattctaataaccagcatgggttctctgaggattttgaggaagtccagcgctgtactgctgatatgaacatcactgcagagcattccaatcatccagaaaacaagcacaaaaacagatacatcaacattttagcatatgatcacagtagggtgaagttaagacctttaccaggaaaagactctaagcacagcgactacattaatgcaaactatgttgatggttacaacaaagcaaaagcctacattgccacccaaggacctttgaagtctacatttgaagatttctggaggatgatttgggaacaaaacactggaatcattgtgatgattacgaaccttgtggaaaaaggaagacgaaaatgtgatcagtattggccaacagagaacagtgaggaatatggaaacattattgtcacgctgaagagcacaaaaatacatgcctgctacactgttcgtcgtttttcaatcagaaatacaaaagtgaaaaagggtcagaagggaaatcccaagggtcgtcagaatgaaagggtagtgatccagtatcactatacacagtggcctgacatgggagttcccgagtatgcccttccagtactgactttcgtgaggagatcctcagcagctcggatgccagaaacgggccctgtgttggtgcactgcagtgctggtgtgggcagaacaggcacctatattgtaatagacagcatgctgcaacagataaaagacaaaagcacagttaacgtcctgggattcctgaagcatatcaggacacagcgtaactacctcgtccagactgaggagcagtacattttcatccatgatgccttgttggaagccattcttggaaaggagactgaagtatcttcaaatcagctgcacagctatgttaacagcatccttataccaggagtaggaggaaagacacgactggaaaagcaattcaagctggtcacacagtgtaatgcaaaatatgtggaatgtttcagtgctcagaaagagtgtaacaaagaaaagaacagaaactcttcagttgtgccatctgagcgtgctcgagtgggtcttgcaccattgcctggaatgaaaggaacagattacattaatgcttcttatatcatgggctattataggagcaatgaatttattataactcagcatcctctgccacatactacgaaagatttctggcgaatgatttgggatcataacgcacagatcattgtcatgctgccagacaaccagagcttggcagaagatgagtttgtgtactggccaagtcgagaagaatccatgaactgtgaggcctttaccgtcacccttatcagcaaagacagactgtgcctctctaatgaagaacaaattatcatccatgactttatccttgaagctacacaggatgactatgtcttagaagttcggcactttcagtgtcccaaatggcctaacccagatgcccccataagtagtacctttgaacttatcaacgtcatcaaggaagaggccttaacaagggatggtcccaccattgttcatgatgagtatggagcagtttcagcaggaatgttatgtgcccttaccaccctgtcccagcaactggagaatgaaaatgctgtggatgttttccaggttgcaaaaatgatcaatcttatgaggcctggagtattcacagacattgaacaataccagttcatctataaagcaatgcttagcttggtcagcactaaagaaaatggaaatggtcccatgacagtagacaaaaatggtgctgttcttattgcagatgaatcagaccctgctgagagcatggagtccctagtgtgactggaatcctgaaagggcacttaatttgtaaacttctgaagactgagaacttttttgaggccttttttgccagactctaggttatacaataacccagttacttttttacactgataaaagttttgatatttattttttgccattttatgtcttaatggtatcctactgagcatttgcacctctgttcatttcacacagtgaaacgcaattttacctagtttgcactatatgatcagtgttactgcctataatcttatacaacagcaaaccctgatgtgacattccatgacgacatacatgctacttttttttagttcaatacagtgaaggtctttgttatgacagtgaatattgcttttattattattattgctgaagtggttgcattctactagcaggcaatgctgtacttttcttcagtcctcctctcctttttattttaggcactgttcaatactgtatgccttctgtattttaatggagtggatagcattgttttcttttacagactagcaggctactgggacctaaaaaggtctgttaatgtcatggccttgaaacagttccatttatgctggttaagagatcccttaagaagttagaaggcttaagaactgcttcatgtgaacatcccttattagttacaaagttatattcacagttttttaaaaatgtgtcaaaataaaggataactctgtattacagctttcacagtagctatgtggacaatgtgttatttccattttgactctctaaaatagctacatcctaaaatcagggctatctttaacaatagcaagatagcaatattatatacaactcagttatgagaccctttagttattctccattaatgcttcttagtttgtaataccatacctcacagtaggtagaagaatgaaaacttctgcaggtgtgtaattttgaaactagtcctctaaaaattccctattactcctatagcaatctaataaaaactacctacatagttactgttttctttccttctttgccaaatgttttataataaatctcttaattacatacatttttctacttaagattaaattggaaatactgtcttagcaaaagtcttgggactatctaaactcccacacatagataaatctgatttggagagagaaatttaaaatatttaattaaaggtgatacccacattttcaagtttttaaaagagggagatggctttgtatgcttttgtgtagtttagaacagatacacattagtaaaagataccaataatcattagagctcaaggaagttattaggtgcagcctctggagccatactcacgctgcagtgcataatgggaaaattaggagcattaataagaaatttcagtagtgtttgtaaggaaaataagctacttactgagatctgtttcttctattgcatgtttgcttttgagggacagcttctgtcaaaagtgaaatcatcaccagaactgggcctgttaggaagaatagggttttatttactttttatgtcaattaacttcaacaaaaaggccacgctggctgctgtcatgccatctgggtatgcattaaacattaatgatgatcagcactgaggttctatttatcttgatttggctttcataaagtttgtcagaatggtgctggaggaccagaagtgctaaggagaaagaagctatgggccaagttaaagaatttgaatgcaaaggccaggtcaatggagttttcataaactacataatttaccagggtttatctcatcttctcaatacatagatttaacaacatggaatactctgcttttcaagagctgcgtaagctagtcctgagataagatgttcaagagagcatgctaagttgcatgtgctagatgagagacacctttacagcccctccgctccaaccagaggtgacacaggaagctctgtaaagttcaagtaaagcttgaacacaggaacactacaactgccagatgctgaggagaatcaggaaagcaatgagctagactctttttttagtcaattaagtgggttgttttagatgtatagagtattgatatgagttaacactttttagtagatggcaaagtgggcttgatgttcaaaagtaatgttcgagttagggttcatggtccctttctcagtaattttttcttaataaaagtaaacactggttcaaagacaaatagcaagtattccctcctgtgctatttatagagggctcaattcgtagaaaggcataccctccaatgcaattctgtggctgtcccttacagtggtttcagaatcacgaaaaaacagctagtaaataggatagaaacaataaaagaaagagtttagaagttccctgtgagcaatctgtgtgtcttcagcgagcttgaaccaaagtcttcatatcctgacccactgaattataagcaattgctacttgcccatcttgccaaagtagtccaaacacacttcaatgaggacagttatatttagcaggtcctcacccctgcaagagacagcatatcctcactattattattcatgtgttattggcaaaaacatagcttgcatctttccagaggcagagtttcaaagacagggttttctttgagacataagcacattgcttaagtacataacaaggttattaacacttgcactcaggggaaaggaaatagctattgcaaattaatgtgtgcaacttaataaaataagctgtttgtgtatatgaatttagctctaggtaagcaaaatgcacacatcatataaaaataaattgcaatgatcagaccaagtggctgtgctggacatcaaagaaaagacatgctgttgccatcaggagaactctttcttatatgcgatagccaagatatcttctttaatatgaaaaaagttaatttctgaatttcaaaaagagtaagattagctaattggtcttcctaatttttatgcctttagagtttttagtctattcaagtagaagagtccagcgaggccaaagaagggttacggtgttcaagttctggttgttggagtttttagcccagagtgacatactgaaatcagtaaataattattttataatgacacagcacaactgccttgttatgaatttttcttaaatgcatatatactgtatttaaaattaaaatatagataccaatttaccaaagatacatattactaattctaagcaaaactaaaaaaaaaacccaactcatcataatttaagaatcaaaatgtagtttgtcttaagaatttagtggttatactggaaatgcattttcaactcctatgttctaaagtttatgttcaaatggtgccagtgaatttttatatgaagggaaaatgcctgctttttttttttttttaacagatgtaatttcacttaaccctttgcgctttcccttagttgtcatttaacatacaatactggctttacttatctctagaaagaagaaggcatgctacaaataggaaggaattgtaataatgatatttggcctctactttgtcttagctgttaaactgtttttagtatttttgttaaatatttgcaaagggaagcattttctacagaggataattaatttcaagaaaaatatcttgagttttaagaaataaacatctccagaaaaggagaaagtcgattttataaaatgtcgcaactctccaacatttggggtagtgactccttttttgttaggacatttgaaactagcaagcagccattgtttctaaagaattctggcttcacattgactcatgtttctttcactccattttgaaatagctaaaaatcattaaaactgtaaatattttgttgcttgggtaagcatcttctgggaactttgtatctatggtatataatcatagaattttatattttcatataaagctaatttttttctagtttcaactccgtcatagttttttttcctttttgtggtggatatgtgaattcaactttctgtgtattgaagtagcaaaaaccatctttacattccaaaagaatccaacatgtgttatttctttgaggcagtgattgtgaaagttgggttttctttttaattccattgaccatttgtgcaataggaattagacataattagtcactgaaaacattcgtcacattgacccatttggaaaaagtgtgctttttttttttttttaaatttgttcagggggaggggttttgtaacctgaaatttttccctttttcttctgtttaaactatatcaaatcattctattatagtgttatttaatatgtaaattgtattgctatacataaaataaagtatggtttttgatgtattca

SEQ ID NO: 24698 - DNA, 2677 bp, Homo sapiens
ccagtttccagccccgcgctcttcgttccttcccagcctgcgccggctctcgggctgtgctgcgctgccgactcaagttggggatcctcggctgctcgccgccgccgcccgcggtccctgcctgccccaggcccggggcatcgccgccggccgccgactccgcgccctgcccgatcggctctctcctttttaaacggaaagcagcctttctccgccgagaggatcgtccccagcgtggctctgcgttcccggtcactttttgagattttccggggggcgctcggcggcttcccggattccaaggggactcgggccgccgagcgcggggggcccgtggagcgggcgagccggggaagcgccccggcttagcggaggctcgcacggaggcaagaacttattcaacaagtttacctccctgctttcctcttttcgatgtgcgttttcggacatgcggaggttactggaaccgtgttggtggattttgttcctgaaaatcaccagttccgtgctccattatgtcgtgtgcttccccgcgttgacagaaggctacgttggggccctgcacgagaatagacacggcagcgcagtgcagatccgcaggcgcaaggcttcaggcgacccgtactgggcctactctggtaagtccagttgttctaatggagatcacacaggccagttaacatcccattcaactcacttgaaagcacactttgaatcacttttatgcctgagttctgtttgctcaaatctttcgtagttcactaaaagttgaaatattcgagcctgtttttcctcaaggttataagcaccttaatttatctctaccacctgtttcctcaacctgttttcccctcaatttgcgtttatttctgaactttactgttaatgagttattgtaccaaacttgtaattttctgaaagacgtagtcttgtcttttctgttttttcaggggctgtgatttcagagagcagaaaatatatggctagtcttgagctgctaaatgtctgctaaacattacaaacatcacatatcagaatgctctattaggctctaagccaagaaatgcaactttatttttaaatcacatcttgttctttgaatatattttagctgtctactcgatggtaatctgcagtccttttcatttttatttttacttttacccttttgagctaatgaagggagagagcattgttctaactatgttgaatgttacattgcaaataattttcttacattttaaggggacaaaaatgaagaccgaaaactagggatagacttttctggattaggcttcccaaaactcccaaaatatgagaggtggattgttatttctagaagagatttttgatgctcaaaaatatatggaaaatgtattaaagctaattaaggaatgcttgagtaagatagaccactttggaaattactttggcactgaataattcaaactccttctatgaaagagcttggaggcatggagtattagtcttaataataaatctatgtattatgcaatgttgttgcatatagaactgaaagtattcttttcataatgatgctcgggtttaaatcctgaatttctcccagcaaatcctgttaaatttatgccagtgtaaaatttataggtctgatctttaattataccttatctattggctttttgcatccttttgtctattgataaatctgctgcccctgcagggagaatatcctatctgttttgttttgcagtgaacagatagtgattctgaagttttccatcacacccagtaccttgtgattagaattatctaattagaggctttttgtcaccatttctgataaatgaaggaaattggcagatgaaagccaaaattacatatatatagcatcttgccaagaaacccaaagaaaatttatcattttgtactctgtggctctgacatcagtcaggaggaggcacaaagtggcttgctatttacagttcatcagtttagaataataatgctgttagtcaggaaattggaagttatatcccattagcatgtccaattgcaaatggcagtgaagagatgaaagcccttaaacttttcccattatgtagttaagaatgaccataagtggtgccatctttgtgatggagtgattgttgatgtctttaactttggtagagttcagaagtctccattttgtatttctggaatgcattgtgtctgaatttgggtattgcctccagtagtagaaggactaatggttcaaattcaagagttggcacactttttctgaaaagatccaggtaacaaacatcaaaagccatgtcgtctttgttgcaactgcccaactctgccattgtagcttaaaagtacccactgacaattctggacagactggctgtgctctgataaaaatttacttatgaatactggaatttgaattttataattttcatgtgtcaggaaatattcttcttttgatttttttctcattcattaaaaaatatacaaaccattcttgctttgcaggctgtgcaaaaacaggtggctggttggatagggtccacaggttatatagtttgtgaacccttgttccagttgatttttttcctagaaatcagataggagagtcatttgaggaattgcttggaaggatgtggactggtttggaagactgaatgaagtcatttgttaggcataatgg

SEQ ID NO: 24699 - DNA, 3391 bp, Homo sapiens
ttcttgagtgtaaagtccagcaggtggaaggactaggcctgggactcctgggtccccggcagtgtctggaggcatggctggggctggcgggggcctcggggtctgggggaacctggtgctgctgggcctgtgcagctggacaggggccagggcgcctgcccccaacccagggaggaacctgacagtggagactcagaccaccagctccatctccctgagctgggaggtccccgatggcctagactcacagaactccaactactgggttcagtgtactggagacggcggcacaacagagactcgaaacacaacagccaccaacgtcaccgtggatggccttggacccgggtcattgtatacgtgttctgtgtgggtggagaaagacggagtaaatagctctgtggggactgtcactactgccacagctcccaacccagtgagaaacctgacagtggaggctcagaccaacagctccatcgccctgacctgggaggtccccgatggcccagacccacagaactccacctacggggttgagtacactggagatggtggcagagcagggactcgaagcacagcacacaccaacatcaccgtggatagacttgaacccgggtgtttgtatgtgttttccgtgtgggtggggaagaatggaatcaacagctcccgggagactcgaaatgccaccacagcccccaacccagtgagaaacctccatatggagactcagaccaacagctccatcgccctatgctgggaagtccccgatggcccataccctcaggactacacctactgggtagagtacactggagacggtggtggcacagagacccgaaacacaacaaataccagtgtgacagctgagagacttgagcccggaaccttgtacacattctctgtatgggcagaaaaaaatggagcacgtggctccaggcagaatgtcagcatctccacagtccccaacgcagtgacaagcctcagcaagcaggactggaccaacagcaccattgctttgcgctggacagctccccagggcccaggccagtcttcctacagctactgggtctcatgggtcagggaaggcatgactgaccccaggacccaaagcacctcaggtactgacatcaccctaaaggaactggaagctggcagcctgtaccacctcaccgtctgggccgagaggaatgaggtcagaggctataacagcaccctcactgcagccactgctcccaatgaggtcacagatctccagaatgaaactcagactaagaactcagtcatgctgtggtggaaggcccctggagacccccactctcagttgtacgtatactgggtccagtgggccagcaagggacatccccggagggggcaagatccccaagcgaattgggtcaaccagaccagcaggaccaatgagacgtggtacaaagtggaggccctggaacccgggacgttgtacaatttcaccgtgtgggcagagaggaatgacgtagccagttccacgcagagcctctgtgcgtccacatacccagacacagtcaccatcacttcctgtgtcagcacctcagcgggctatggagtcaacttgatctggtcctgcccccagggaggctacgaggcctttgagttggaggtgggaggacagcggggctcccaggacagatcttcatgtggggaggctgtgtctgtgttgggtctcgggccggctcggtcctacccagccaccatcacgaccatctgggacggaatgaaggtcgtgtctcactctgtggtctgccacaccgagagtgcaggggtcattgccggagcctttgtgggcatcctcctgtttctcatcctcgtgggcctgctgattttcttcctgaagaggaggaataagaagaagcagcagaaaccagaactcagggatctggtctttagctccccaggggacatcccagctgaagacttcgctgaccacgtcaggaagaatgagagggacagcaactgtggttttgcagacaagtaccagcaactctccctggtgggccacagccagtctcagatggtggcttcggcttcagagaacaacgccaagaaccgctacagaaatgtgctgccctatgactggtcccgggtgcccctgaagcccatccatgaggagccaggctctgactacatcaatgccagcttcatgcccggtctctggagcccccaggagttcattgcaacccagggtcccctgccacagacagtgggtgacttctggcgcctggtgtgggaacagcagagccacaccctggtcatgctgaccaactgcatggaggccggccgggtgaagtgtgagcattactggcctctggactcgcagccctgcacccatgggcacctgcgggtaaccctggtaggtgaggaagtgatggagaactggacggtgcgggaactgctgctcctccaggtggaggagcagaagacactgtctgtgcgccaattccactaccaggcctggccggatcacggcgttccctcctccccagacaccttgctggctttctggaggatgcttcggcagtggctggatcagaccatggagggaggcccacccattgtgcactgcagtgctggcgtgggtcgcacaggaaccctcattgccctggacgtcctgctccggcagctgcagtccgagggtctccttgggcccttcagctttgtaaggaagatgagagagagtcggccgttgatggtgcagactgaggctcagtacgtattcctgcatcagtgcatcctgcggttcctccaacagtcagcccaggccccagccgagaaggaagtcccgtatgaggatgtcgaaaacctcatctacgagaacgtggccgccatccaggcccacaagttggaggtctaagtgacgagggggctgggtcggcagcccaggcatcctcaagctctggacacccacttgagcccagattcctggaagagcagagggctgggctcccagactcctgggtgctgtgggaggagggggctggtatcccaaactctggtttccccaggagagagtggtctggtgggcttcagatgagtcctatgggagctggggatctggattcctggttccctgaaggaggagagggatgatagcttggattccctaggtctttccaggatgcagaaagaaacaggctggggcctggattctgaggcaggaaggaatttgggtctggagttctggctacttgaggaccaaaggcaggaaggatcctgccttgattttacttcagaaaccaaatcagtcttctataatctggggtcggagggagtccctgtgcccaaggtctctctgcaccccaccatccacatgtatttttccttctatcccataatttattaaatcactgttctcccc

SEQ ID NO: 24700 - DNA, 3925 bp, Homo sapiens
ttcttgagtgtaaagtccagcaggtggaaggactaggcctgggactcctgggtccccggcagtgtctggaggcatggctggggctggcgggggcctcggggtctgggggaacctggtgctgctgggcctgtgcagctggacaggggccagggcgcctgcccccaacccagggaggaacctgacagtggagactcagaccaccagctccatctccctgagctgggaggtccccgatggcctagactcacagaactccaactactgggttcagtgtactggagacggcggcacaacagagactcgaaacacaacagccaccaacgtcaccgtggatggccttggacccgggtcattgtatacgtgttctgtgtgggtggagaaagacggagtaaatagctctgtggggactgtcactactgccacagctcccaacccagtgaggaacctgagagtggaggctcagaccaacagctccatcgccctgacctgggaggtccccgacggcccagacccacagaactccacctacggggttgagtacactggagatggtggcagagcagggactcgaagcacagcacacactaacatcaccgtggatggacttgaacccgggtgtttgtatgcgttttccatgtgggtgggaaagaatggaatcaacagctcccgggagactcgaaatgccaccacagctcacaacccagtgaggaacctgagagtggaggctcagaccaccagctccatctccctgagctgggaggtccccgatggcacagacccacagaactcgacctactgcgttcagtgcactggagatggtggcagaacagagactcgaaacacaacagacaccagagtcaccgtggatggccttggacccgggtcattgtatacgtgttctgtgtgggtggagaaagacggagtaaatagctctgtggagattgtcactagtgccacagctcccaacccagtgagaaacctgacagtggaggctcagaccaacagctccatcgccctgacctgggaggtccccgatggcccagacccacagaactccacctacggggttgagtacactggagatggtggcagagcagggactcgaagcacagcacacaccaacatcaccgtggatagacttgaacccgggtgtttgtatgtgttttccgtgtgggtggggaagaatggaatcaacagctcccgggagactcgaaatgccaccacagcccccaacccagtgagaaacctccatatggagactcagaccaacagctccatcgccctatgctgggaagtccccgatggcccataccctcaggactacacctactgggtagagtacactggagacggtggtggcacagagacccgaaacacaacaaataccagtgtgacagctgagagacttgagcccggaaccttgtacacattctctgtatgggcagaaaaaaatggagcacgtggctccaggcagaatgtcagcatctccacagtccccaacgcagtgacaagcctcagcaagcaggactggaccaacagcaccattgctttgcgctggacagctccccagggcccaggccagtcttcctacagctactgggtctcatgggtcagggaaggcatgactgaccccaggacccaaagcacctcaggtactgacatcaccctaaaggaactggaagctggcagcctgtaccacctcaccgtctgggccgagaggaatgaggtcagaggctataacagcaccctcactgcagccactgctcccaatgaggtcacagatctccagaatgaaactcagactaagaactcagtcatgctgtggtggaaggcccctggagacccccactctcagttgtacgtatactgggtccagtgggccagcaagggacatccccggagggggcaagatccccaagcgaattgggtcaaccagaccagcaggaccaatgagacgtggtacaaagtggaggccctggaacccgggacgttgtacaatttcaccgtgtgggcagagaggaatgacgtagccagttccacgcagagcctctgtgcgtccacatacccagacacagtcaccatcacttcctgtgtcagcacctcagcgggctatggagtcaacttgatctggtcctgcccccagggaggctacgaggcctttgagttggaggtgggaggacagcggggctcccaggacagatcttcatgtggggaggctgtgtctgtgttgggtctcgggccggctcggtcctacccagccaccatcacgaccatctgggacggaatgaaggtcgtgtctcactctgtggtctgccacaccgagagtgcaggggtcattgccggagcctttgtgggcatcctcctgtttctcatcctcgtgggcctgctgattttcttcctgaagaggaggaataagaagaagcagcagaaaccagaactcagggatctggtctttagctccccaggggacatcccagctgaagacttcgctgaccacgtcaggaagaatgagagggacagcaactgtggttttgcagacaagtaccagcaactctccctggtgggccacagccagtctcagatggtggcttcggcttcagagaacaacgccaagaaccgctacagaaatgtgctgccctatgactggtcccgggtgcccctgaagcccatccatgaggagccaggctctgactacatcaatgccagcttcatgcccggtctctggagcccccaggagttcattgcaacccagggtcccctgccacagacagtgggtgacttctggcgcctggtgtgggaacagcagagccacaccctggtcatgctgaccaactgcatggaggccggccgggtgaagtgtgagcattactggcctctggactcgcagccctgcacccatgggcacctgcgggtaaccctggtaggtgaggaagtgatggagaactggacggtgcgggaactgctgctcctccaggtggaggagcagaagacactgtctgtgcgccaattccactaccaggcctggccggatcacggcgttccctcctccccagacaccttgctggctttctggaggatgcttcggcagtggctggatcagaccatggagggaggcccacccattgtgcactgcagtgctggcgtgggtcgcacaggaaccctcattgccctggacgtcctgctccggcagctgcagtccgagggtctccttgggcccttcagctttgtaaggaagatgagagagagtcggccgttgatggtgcagactgaggctcagtacgtattcctgcatcagtgcatcctgcggttcctccaacagtcagcccaggccccagccgagaaggaagtcccgtatgaggatgtcgaaaacctcatctacgagaacgtggccgccatccaggcccacaagttggaggtctaagtgacgagggggctgggtcggcagcccaggcatcctcaagctctggacacccacttgagcccagattcctggaagagcagagggctgggctcccagactcctgggtgctgtgggaggagggggctggtatcccaaactctggtttccccaggagagagtggtctggtgggcttcagatgagtcctatgggagctggggatctggattcctggttccctgaaggaggagagggatgatagcttggattccctaggtctttccaggatgcagaaagaaacaggctggggcctggattctgaggcaggaaggaatttgggtctggagttctggctacttgaggaccaaaggcaggaaggatcctgccttgattttacttcagaaaccaaatcagtcttctataatctggggtcggagggagtccctgtgcccaaggtctctctgcaccccaccatccacatgtatttttccttctatcccataatttattaaatcactgttctcccc

SEQ ID NO: 24701 - DNA, 7846 bp, Homo sapiens
cagccccagccgcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactgttcccagtgcagtgtttgacatccacgtggtctacgtcaccaccacggagatgtggctggactggaagagccctgacggtgcttccgagtatgtctaccatttagtcatagagtccaagcatggctctaaccacacaagcacgtatgacaaagcgattactctccagggcctgattccgggcaccttatataacatcaccatctctccagaagtggaccacgtctggggggaccccaactccactgcacagtacacacggcccagcaatgtgtccaacattgatgtaagtaccaacaccacagcagcaactttaagttggcagaactttgatgacgcctctcccacgtactcctactgccttcttattgagaaggctggaaattccagcaacgcaacacaagtagtcacggacattggaattactgacgctacagtcactgaattaatacctggctcatcatacacagtggagatctttgcacaagtaggggatgggatcaagtcactggaacctggccggaagtcattctgtacagatcctgcgtccatggcctccttcgactgcgaagtggtccccaaagagccagccctggttctcaaatggacctgccctcctggcgccaatgcaggctttgagctggaggtcagcagtggagcctggaacaatgcgacccacctggagagctgctcctctgagaatggcactgagtatagaacggaagtcacgtatttgaatttttctacctcgtacaacatcagcatcaccactgtgtcctgtggaaagatggcagcccccacccggaacacctgcactactggcatcacagatccccctcctccagatggatcccctaatattacatctgtcagtcacaattcagtaaaggtcaagttcagtggatttgaagccagccacggacccatcaaagcctatgctgtcattctcaccaccggggaagctggtcacccttctgcagatgtcctgaaatacacgtatgaggatttcaaaaagggagcctcagatacttatgtgacatacctcataagaacagaagaaaagggacgttctcagagcttgtctgaagttttgaaatatgaaattgacgttgggaatgagtcaaccacacttggttattacaatgggaagctggaacctctgggctcctaccgggcttgtgtggctggcttcaccaacattaccttccaccctcaaaacaaggggctcattgatggggctgagagctatgtgtccttcagtcgctactcagatgctgtttccttgccccaggatccaggtgtcatctgtggagcggtttttggctgtatctttggtgccctggttattgtgactgtgggaggcttcatcttctggagaaagaagaggaaagatgcaaagaataatgaagtgtccttttctcaaattaagtaatagatctaagttaatcagagtggagaattttgaggcctacttcaagaagcagcaagctgactccaactgtgggttcgcagaggaatacgaagatctgaagcttgttggaattagtcaacctaaatatgcagcagaactggctgagaatagaggaaagaatcgctataataatgttctgccctatgatatttcccgtgtcaaactttcggtccagacccattcaacggatgactacatcaatgccaactacatgcctggctaccactccaagaaagattttattgccacacaaggacctttaccgaacactttgaaagatttttggcgtatggtttgggagaaaaatgtatatgccatcattatgttgactaaatgtgttgaacagggaagaaccaaatgtgaggagtattggccctccaagcaggctcaggactatggagacataactgtggcaatgacatcagaaattgttcttccggaatggaccatcagagatttcacagtgaaaaatatccagacaagtgagagtcaccctctgagacagttccatttcacctcctggccagaccacggtgttcccgacaccactgacctgctcatcaacttccggtacctcgttcgtgactacatgaagcagagtcctcccgaatcgccgattctggtgcattgcagtgctggggtcggaaggacgggcactttcattgccattgatcgtctcatctaccagatagagaatgagaacaccgtggatgtgtatgggattgtgtatgaccttcgaatgcataggcctttaatggtgcagacagaggaccagtatgttttcctcaatcagtgtgttttggatattgtcagatcccagaaagactcaaaagtagatcttatctaccagaacacaactgcaatgacaatctatgaaaaccttgcgcccgtgaccacatttggaaagaccaatggttacatcgcctaattccaaaggaataacctttctggagtgaaccagaccgtcgcacccacagcgaaggcacatgccccgatgtcgacatgtttttatatgtctaatatcttaattctttgttctgttttgtgagaactaattttgagggcatgaagctgcatatgatagatgacaaattggggctgtcgggggctgtggatgggtggggagcaaatcatctgcattcctgatgaccaatgggatgaggtcactttttttttttttcccccttgaggattgtggaaaaccaggaaaagggagctatgatttttttttccaaaacaatttcttttttaaaaaagactattttatatgattcacatgctaaagccaggattgtgttgggttgaatatattttaagtatcagaggtctatttttacctactgtgtcttggaatctagccgatggaaaatacctaattgtggatgatgattgcgcagggaggggtacgtggcacctcttccgaatgggttttctatttgaacatgtgccttttctgaattatgcttccacaggcaaaactcagtagagatctatatttttgtactgaatctcataattggaatatacggaatatttaaacagtagcttagcatcagaggtttgcttcctcagtaacatttctgttctcatttgatcaggggaggcctctttgccccgactccgcttcccctgccccctgtacatttgtgctccattttttcttcccttttccctcccagttttctccaaagactcttctgttggcaacattttcaacccattggttgggtgagaatggcgactcaaatatcaccttgagaatttctgtgggtgggaatgggagaagcagaggaatcctacagtggcagaaatccttttcttgtccctgtattatcctttttctcatgtctgtatttggtatgaaggattatttaaaggtgcaatatgtgaattagtgattcatgatgttctaggtttttagtaacgttttactcaggttggcattttatgtgtctgtgtctgtatgtgtgtgtgtatgttcagaagcgtggcaatctgtgaacacttcagcgtgaattcagtgtcagattaatccctccttccccaaagtccactggctttcgtctctctctgccgtgacacatatcggaatctactgtgtatatatatatatatatatatatatatatatatatatatatatatatacactaagctctcaaaaacagtcattcctatgaattgaggtgtacaaagtttgaatttgtatcaaagatgtaattattatttttaaaaccttttcactatactgctgctgtaattactttgatttttaaaatgtagattaatttttttttttttgcttcaggtgtgtatccaccaagaatttcaaatttatgtggatttattttattggtacataatctgtaaacttcttaaggcattaacatgaaaagattttttctttttattttatattgtggctcaggttatattttgaagatgttttgagtttatcctccaataggcaatgaagttgacaaggttttatgaaggaataaccaagtccctggagtcctgtggctgttgccacagtaatgtgtcctgctgtaaacaggacaggtgtgtcctgttgagaatgtgagcgggctcttccagcctcctggtccctcctgactctgccacgcccctcacctcactggcacttcgataactgactggacgtgttaatgggtcttttagggttctaaagggtgaaccacacttttaaagccccggctgtggttcggagggttagtgctgtatgccttttatttccctttccctttgaggtactgaaaggatgaaaaggtggtgtcatgttttggggagaatcttacttctcaaatggaaattgcactttttgctgaatcctttgcatttttttggtagtaagcagttcattgagtatcaggtcctcaaaggaatgagttggcccggctagggtgggccctcttgacctaacttcagagggggccttggctcagtaggtgtgaatcagggaagccacattgtcctcagggtgctgtatgaagctgggtgtgggcggattcctcccacaccttcacactggcctgcctccaactcatacagatctcggagcggtcggtacttcattcataggtccctgttcaggcagcagttctgtgggctgtggccctctcccctccaatatgtccgaaaccattgtgatgggtggcaaatcccagggagctcctaagccctgctctgcccacatcactgccacagagaagtcagaggaagggacttgttgctaaaaaatcctttaaaaggttaaatactttaaaagattaaagcaacataactgtaaacatattgtataaaaatgaaaaacacaggaaccctcttcccttccgcctggtgtgggcttgggaaatgggcaagcggccccagcaatcatgggaggaactcttgcgggggagcggtctgggattccaaatgggcaggtcacacgaaggtcacgatgcttctctgcatcctgaaaagggctggggacagggccagtgggggtggtaagggtatttatagcacagtgcttgaaaagggaagattaatgtgtaaatataaaggacacacaggctgggggttggtcagaggcaagaggagggtgcctctgagcttcaacccctcccaggaacaatgagctcaaattggaagagtccagtggaatcggggggatggtgtgagcacccctgttcagtctttgacaattgcatacagaaaagcagctggtatgggtttgggtgtcaatgaaagggccaaagactggtggccagctggtttgggggatttgggccattgatagcatctcccaggaacaacgactttttgcctccaaagttggatctagtgatgatcagcaccagcaggaaatgacatttggtgtctgcccactgcagccatactgtgacctccagccagacttccgcctaattgactccactggatttgtgctctgttgagtcagaggctcccgggggttggggatcgaggggcgggggtcagctatgcagcccatcacgtgtgtttttcatctgggatgaaaaagcctggttctcttttgaaatgcttgattgtacttattgagctaaacaagtcttggtgactgttgttgatttgcctcaaaagttttaagtcctgggttttcagactactgtgtagcagctgtgtgtttaacatactgtagctttttctcccttgggggcacatacaaataggatgtgttgatgtggactctaaactgtaattttcctgtaactattttggaatgatgcatatttctaatgtttgttatacttgtacagagtattgctgttggttgctttttttttttttaaggaaaaaatggcctgaaaacatttttttaaagacttacaaataccaaatataaaaaaatgtcaatgcatt

SEQ ID NO: 24702 - DNA, 5122 bp, Homo sapiens
ccccagccgcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactgttcccagtgcagtgtttgacatccacgtggtctacgtcaccaccacggagatgtggctggactggaagagccctgacggtgcttccgagtatgtctaccatttagtcatagagtccaagcatggctctaaccacacaagcacgtatgacaaagcgattactctccagggcctgattccgggcaccttatataacatcaccatctctccagaagtggaccacgtctggggggaccccaactccactgcacagtacacacggcccagcaatgtgtccaacattgatgtaagtaccaacaccacagcagcaactttaagttggcagaactttgatgacgcctctcccacgtactcctactgccttcttattgagaaggctggaaattccagcaacgcaacacaagtagtcacggacattggaattactgacgctacagtcactgaattaatacctggctcatcatacacagtggagatctttgcacaagtaggggatgggatcaagtcactggaacctggccggaagtcattctgtacagatcctgcgtccatggcctccttcgactgcgaagtggtccccaaagagccagccctggttctcaaatggacctgccctcctggcgccaatgcaggctttgagctggaggtcagcagtggagcctggaacaatgcgacccacctggagagctgctcctctgagaatggcactgagtatagaacggaagtcacgtatttgaatttttctacctcgtacaacatcagcatcaccactgtgtcctgtggaaagatggcagcccccacccggaacacctgcactactggcatcacagatccccctcctccagatggatcccctaatattacatctgtcagtcacaattcagtaaaggtcaagttcagtggatttgaagccagccacggacccatcaaagcctatgctgtcattctcaccaccggggaagctggtcacccttctgcagatgtcctgaaatacacgtatgaggatttcaaaaagggagcctcagatacttatgtgacatacctcataagaacagaagaaaagggacgttctcagagcttgtctgaagttttgaaatatgaaattgacgttgggaatgagtcaaccacacttggttattacaatgggaagctggaacctctgggctcctaccgggcttgtgtggctggcttcaccaacattaccttccaccctcaaaacaaggggctcattgatggggctgagagctatgtgtccttcagtcgctactcagatgctgtttccttgccccaggatccaggtgtcatctgtggagcggtttttggctgtatctttggtgccctggttattgtgactgtgggaggcttcatcttctggagaaagaagaggaaagatgcaaagaataatgaagtgtccttttctcaaattaaacctaaaaaatctaagttaatcagagtggagaattttgaggcctacttcaagaagcagcaagctgactccaactgtgggttcgcagaggaatacgaagatctgaagcttgttggaattagtcaacctaaatatgcagcagaactggctgagaatagaggaaagaatcgctataataatgttctgccctatgatatttcccgtgtcaaactttcggtccagacccattcaacggatgactacatcaatgccaactacatgcctggctaccactccaagaaagattttattgccacacaaggacctttaccgaacactttgaaagatttttggcgtatggtttgggagaaaaatgtatatgccatcattatgttgactaaatgtgttgaacagggaagaaccaaatgtgaggagtattggccctccaagcaggctcaggactatggagacataactgtggcaatgacatcagaaattgttcttccggaatggaccatcagagatttcacagtgaaaaatatccagacaagtgagagtcaccctctgagacagttccatttcacctcctggccagaccacggtgttcccgacaccactgacctgctcatcaacttccggtacctcgttcgtgactacatgaagcagagtcctcccgaatcgccgattctggtgcattgcagtgctggggtcggaaggacgggcactttcattgccattgatcgtctcatctaccagatagagaatgagaacaccgtggatgtgtatgggattgtgtatgaccttcgaatgcataggcctttaatggtgcagacagaggaccagtatgttttcctcaatcagtgtgttttggatattgtcagatcccagaaagactcaaaagtagatcttatctaccagaacacaactgcaatgacaatctatgaaaaccttgcgcccgtgaccacatttggaaagaccaatggttacatcgcctaattccaaaggaataacctttctggagtgaaccagaccgtcgcacccacagcgaaggcacatgccccgatgtcgacatgtttttatatgtctaatatcttaattctttgttctgttttgtgagaactaattttgagggcatgaagctgcatatgatagatgacaaattggggctgtcgggggctgtggatgggtggggagcaaatcatctgcattcctgatgaccaatgggatgaggtcactttttttttttttcccccttgaggattgtggaaaaccaggaaaagggagctatgatttttttttccaaaacaatttcttttttaaaaaagactattttatatgattcacatgctaaagccaggattgtgttgggttgaatatattttaagtatcagaggtctatttttacctactgtgtcttggaatctagccgatggaaaatacctaattgtggatgatgattgcgcagggaggggtacgtggcacctcttccgaatgggttttctatttgaacatgtgccttttctgaattatgcttccacaggcaaaactcagtagagatctatatttttgtactgaatctcataattggaatatacggaatatttaaacagtagcttagcatcagaggtttgcttcctcagtaacatttctgttctcatttgatcaggggaggcctctttgccccgactccgcttcccctgccccctgtacatttgtgctccattttttcttcccttttccctcccagttttc

SEQ ID NO: 24703 - DNA, 3158 bp, Homo sapiens
ggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactggatgatttgaacacctgcctggaattccatcatctgaaacagagttggcagataagaatggcccctatgccaaatttggctcattgtctgtttttgtaaataaagttttattggatcacagccatgttcatttgcttatgtactgtctatggctactttggtgctagaattgagtagtggcagcagagaacgtgtggcttgtgaagcctgagatatttattttctggccattacagagaatgtttgctgacctctgggctagatcagtggttttcaaattgtggtccagggctctctagggatccctaggttctttcaaggggtctccaaggtagtattatcataacaatactaaaatgttatttggctttttcattctcattctcttttggagttttccaactttgatccgatatgggatgacattgtctctcaggtctaatggaatatatgctgtggattcttacattttaaaaatttcttcattttaaatccctgatatagtaaatattaataaatataacctatgtaaatacaaattctctgagagccttaataacttttaagatggtaaagaagtcctgagagcaaaaagtttaagaacctctggtcaagatgtgttagaaattaactactgtgctgtgttgggcaggtggactgttcacagtctttcctaaacaacactgtgatgagatactttgttagttctagaaggctaattgaaattgataaaatcattttatagtcagctacggtggcctgcacccatcgtcccagctacttgagaggctgcggcaggaggattgcttggcccaacagttgcagactagcaccagcctgggagaccctgtctcaaaaaaaaatttttttttatagaaacagtttaaattattaaattatttctaggcctacaggagaaacttctgggaaatcctagagagtaatgttcattattgttgttttaaaattttgaaataattgttttttggaaaggttgaaaaacatacagtcttccttgatctaagattcaagatagttgaaatcttttatacagagggtagaataaagatatacctaatgtaaatgatgagttaatgggtgcagcacaccaacatggcacatgtatacatatgtaacaaacctgcacgttgtgcacatgtaccctagaacttaaagtataataaaaacatatatatatatataaaagaaa

SEQ ID NO: 24704 - DNA, 4758 bp, Homo sapiens
tccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagttcctataacagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagac

SEQ ID NO: 24705 - DNA, 5025 bp, Homo sapiens
gagcaaagtaactcttgactaacaggagcagcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatga

SEQ ID NO: 24706 - DNA, 5816 bp, Homo sapiens
tccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgg

SEQ ID NO: 24707 - DNA, 4651 bp, Homo sapiens
atggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgtt

SEQ ID NO: 24708 - DNA, 6087 bp, Homo sapiens
agaagcgcccggagcccgcggggcgacgtcacccccggctccgcccccgtccctccccgagcaaagtaactcttgactaacaggagcagcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattataacagtta

SEQ ID NO: 24709 - DNA, 6188 bp, Homo sapiens
gtctctccggcaggaggcggtggcggcgccgcgcccgagcccgcattcctcagaagcgcccggagcccgcggggcgacgtcacccccggctccgcccccgtccctccccgagcaaagtaactcttgactaacaggagcagcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatgtaagtatttttataggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattataacagtt

SEQ ID NO: 24710 - DNA, 2768 bp, Homo sapiens
gtctctccggcaggaggcggtggcggcgccgcgcccgagcccgcattcctcagaagcgcccggagcccgcggggcgacgtcacccccggctccgcccccgtccctccccgagcaaagtaactcttgactaacaggagcagcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagatatatatgttggagaagacacatctgcattagaaacattaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagtcccttctccaggaagaaaaaatgtttatcatggggacaacaattcattttttgctatatcctatttgtag

SEQ ID NO: 24711 - DNA, 5757 bp, Homo sapiens
ggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagttcctataacagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgg

SEQ ID NO: 24712 - DNA, 5058 bp, Homo sapiens
atgaggggacttgggacttgcctggcgactttggccggacttttgctaactgcggcgggcgagacgttctcaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaagcaca

SEQ ID NO: 24713 - DNA, 5292 bp, Homo sapiens
gtgctgtggcccaatcctgtgcgtgtctcctcttcaggctcctgccggagcatgcttctctaatcttaccatttatcactgacccttcggtgaaactctcttctgtttaaatttaccagggtacactttgtaatacttgggaccaagaatttgaagatagtaatcagacaaatcaaacaactagtagtagtggagagacacgtagccctacaggaaggggtagaattatcattaaaaacacagacaaaccagagactgcctgaaaaaaaaaaaaagatgaactggaaagattcaaagtaggctctattggaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaa

SEQ ID NO: 24714 - DNA, 4401 bp, Homo sapiens
atgaggggacttgggacttgcctggcgactttggccggacttttgctaactgcggcgggcgagacgttctcaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagacccatttgtgccaactgcaattttagacttttctctaaacaatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctga

SEQ ID NO: 24715 - DNA, 4414 bp, Homo sapiens
atgggaaccctctccctccatcctggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaa

SEQ ID NO: 24716 - DNA, 3784 bp, Homo sapiens
aggtaggtcccccgctccgacagggctcttacgccatatgtgacgcaaattagcttacgagccgggggtggaggtgtcgtcagcacccgcctgcggttggccgcgttgcagcgagaggggcatgtagaccccgcctcgtagggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaagcccctgagcctggctgcaggagtgaagctgctggagatcctggctgagcatgtgcacatgtcctcaggcagcttcatcaacatcagtgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaa

SEQ ID NO: 24717 - DNA, 3622 bp, Homo sapiens
gtcgtcagcacccgcctgcggttggccgcgttgcagcgagaggggcatgtagaccccgcctcgtagggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaatgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaa

SEQ ID NO: 24718 - DNA, 1076 bp, Homo sapiens
agcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcc

SEQ ID NO: 24719 - DNA, 3313 bp, Homo sapiens
attgcaggttcgggagaaggacacggggtgcatgtgggcagagggacttagagaccggctgcgagaccacaggagaagccacttgctccgaggcgcctgggaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaagcccctgagcctggctgcaggagtgaagctgctggagatcctggctgagcatgtgcacatgtcctcaggcagcttcatcaacatcagtgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagg

SEQ ID NO: 24720 - DNA, 3281 bp, Homo sapiens
gtcgtcagcacccgcctgcggttggccgcgttgcagcgagaggggcatgtagaccccgcctcgtagggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaatgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctggcctgcctctgactcacacttgggcgctctgccctccctggcctcacgcccagcctcctcccaccaccctcccaccatgcgctgctcaacctctctccttctg

SEQ ID NO: 24721 - DNA, 4723 bp, Homo sapiens
ggcgggaggagccggcggcgcgcgcctccctgggcccggactcggccgcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcagggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaagatgatcacatggaaggcggcacagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 24722 - DNA, 4692 bp, Homo sapiens
ccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctggatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcagggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaagatgatcacatggaaggcggcacagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatt

SEQ ID NO: 24723 - DNA, 4706 bp, Homo sapiens
ggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcagggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaagatgatcacatggaaggcggcacagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttc

SEQ ID NO: 24724 - DNA, 3117 bp, Homo sapiens
atggctgtggaatctgaatattcactgctgagaaccgaagccagctttcctactatgaagatgttctgtgtgagccacaccttgcccagggtggaagtgatgtttgtttcaggtccacagacgagggagaggacggagccagtggaccctcggtggcagtgtctggtgcagatgtgggcaggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtga

SEQ ID NO: 24725 - DNA, 4711 bp, Homo sapiens
gagcgcgagaggcgcggcgggaggagccggcggcgcgcgcctccctgggcccggactcggccgcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcagggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaagatgatcacatggaaggcggcacagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 24726 - DNA, 5301 bp, Homo sapiens
cgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtgagaatagctaatctgctgccagcatggtactacaacttccgggttaccatggtgacgtggggagatccagaattgagctgctgtgacagctctaccatcagcttcataacagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtaacacgcaatgtcatgactgcaattctcagcttgcctccaggcgacatctataacctctcagtaactgcttgtactgaaagaggaagtaatacctccatgctccgccttgtcaagctagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaa

SEQ ID NO: 24727 - DNA, 5061 bp, Homo sapiens
gggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtgagaatagctaatctgctgccagcatggtactacaacttccgggttaccatggtgacgtggggagatccagaattgagctgctgtgacagctctaccatcagcttcataacagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtaacacgcaatgtcatgactgcaattctcagcttgcctccaggcgacatctataacctctcagtaactgcttgtactgaaagaggaagtaatacctccatgctccgccttgtcaagctagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaa

SEQ ID NO: 24728 - DNA, 3030 bp, Homo sapiens
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtgg

SEQ ID NO: 24729 - DNA, 4062 bp, Homo sapiens
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagtaagtggagaagagctctccacgagtgctcagtcttagaactattagagggggatgtgatggatgggacaaaagacagcagtagccatttgtattgactctgacttcacatgagtatttcttcccagctcctggcctcacatgggtggtcacagggagaaacaagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttacttgagagcttcatgaagacacttgtaacatattcaacgtcctgtactccagttttgactacgagatcagattttggaggtgtaagtaaacttggctgaggtaacagtaatctgcccatttagttcagtaaacagactgtagagtgtctgactatactgggggaagaggagccaatgacagggtagggagatgacagtggtgcatgatgggagaatcatgaaagtctgggaagcatatggaccagtgggaaggataggattagcactgcacctctacatccatcaagagagacagagcgcacaatggagcaggaaggataaaaaataaagaaagacagagagaaacaaatttgctgggagagggaaagacattcagacccacagaaaggaggcagcacacagagaaagatgcacagatcaacccacatctgcatgggttgtgagactgagcatagtgagagcagtggtggagcaatagaagattgctgtgacaccaggctgcttactgtctttctttgtctcattcacaggagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtgg

SEQ ID NO: 24730 - DNA, 2946 bp, Homo sapiens
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtgg

SEQ ID NO: 24731 - DNA, 3978 bp, Homo sapiens
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagtaagtggagaagagctctccacgagtgctcagtcttagaactattagagggggatgtgatggatgggacaaaagacagcagtagccatttgtattgactctgacttcacatgagtatttcttcccagctcctggcctcacatgggtggtcacagggagaaacaagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttacttgagagcttcatgaagacacttgtaacatattcaacgtcctgtactccagttttgactacgagatcagattttggaggtgtaagtaaacttggctgaggtaacagtaatctgcccatttagttcagtaaacagactgtagagtgtctgactatactgggggaagaggagccaatgacagggtagggagatgacagtggtgcatgatgggagaatcatgaaagtctgggaagcatatggaccagtgggaaggataggattagcactgcacctctacatccatcaagagagacagagcgcacaatggagcaggaaggataaaaaataaagaaagacagagagaaacaaatttgctgggagagggaaagacattcagacccacagaaaggaggcagcacacagagaaagatgcacagatcaacccacatctgcatgggttgtgagactgagcatagtgagagcagtggtggagcaatagaagattgctgtgacaccaggctgcttactgtctttctttgtctcattcacaggagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtgg

SEQ ID NO: 24732 - DNA, 6888 bp, Homo sapiens
atggattttcttatcatttttcttttactttttattgggacttcagagacacaggttgatgtttccaatgtcgttcctggtactaggtacgatataaccatctcttcaatttctacaacatacacctcacctgttactagaatagtgacaacaaatgtaacaaaaccagggcctccagtcttcctagccggggaaagagtcggatctgctgggattcttctgtcttggaatacaccacctaatccaaatggaaggattatatcttacattgtcaaatataaggaagtttgtccgtggatgcaaacagtatatacacaagtcagatcaaagccagacagtctggaagttcttcttactaatcttaatcctggaacaacatatgaaattaaggtaattattttaaatgcaacaaaagtaggatgtctactctcaccaatcctattgaacacagtactggaaggcctagccagagcgatcaatctcactagggagtgccagacagtggatgcaggtcagtgcgtgcagtgcgccgtgagagagccgaagcagggctccacctctgggggcagggcacagacaaacaaaaagacagcagtaacctctgcagacttaaatcacacagctggagatctgagaacgggcagactgcctcctcaacccctgaccgccgagcagcctaactgggaggcaccccccagtagaggcagactgacacctcacaaggccgggtactcctctgccaccgctgctggtacccaggctaacagggtctggagtagacctctagcaaaaatacaaactaccatcagagaatactacaaacacctctatgcaaaaaaagagggaatcctccctaactcattttatgaggccagcatcatcctgataccaaagccggtgcctgaaggaccaccacaaaactgcgtaacaggcaacatcacaggaaagtccttttcaattttatgggacccaccaactatagtaacagggaaatttagttatagagttgaattatatggaccatcaggtcgcattttggataacagcacaaaagacctcaagtttgcattcactaacctaacaccatttacaatgtatgatgtctatattgcggctgaaaccagtgcagggactgggcccaagtcaaatatttcagtattcactccaccagatgttccaggggcagtgtttgatttacaacttgcagaggtagaatccacgcaagtaagaattacttggaagaaaccacgacaaccaaatggaattattaaccaataccgagtgaaagtgctagttccagagacaggaataattttggaaaatactttgctcactggaaataatgagtatataaatgaccccatggctccagaaattgtgaacatagtagagccaatggtaggattatatgagggttcagcagagatgtcgtctgaccttcactcacttgctacatttatatataacagccatccagataaaaactttcctgcaaggaatagagctgaagaccagacttcaccagttgtaactacaaggaatcagtatattactgacattgcagctgaacagctgtcttatgttatcaggagacttgtacctttcactgagcacatgattagtgtatctgctttcaccatcatgggagaaggaccaccaacagttctcagtgttaggacacgtcagcaagtgccaagctccattaaaattataaactataaaaatattagttcttcatctattttgttatattgggatcctccagaatatcccaatggaaaaataactcactatacgatttatgcaatggaattggatacaaacagagcattccagataactaccatagataacagctttctcataacagggttaaagaaatacacaaaatacaaaatgagagtggcagcctcaacccacgttggagaaagttctttgtctgaagaaaatgacatctttgtgagaacttcagaagatgaaccggaatcatcacctcaagatgtcgaagtaattgatgttaccgcagatgaaataaggttgaagtggtcaccacccgaaaagcccaatgggatcattattgcttatgaagtgctatataaaaatatagatactttatatatgaagaacacatcaacaacagacataatattaaggaacttaagacctcacaccctctataacatttctgtaaggtcttacaccagatttggtcatggcaatcaggtatcttctttactctctgtaaggacttcggagactgtgcctgatagtgcaccagaaaatatcacttacaaaaatatttcttctggagagattgagctatcattccttcccccaagtagtcccaatggaatcatacaaaaatatacaatttatctcaagagaagtaatggaaatgaggaaagaactataaatacaacctctttaacccaaaacattaaagtactgaagaaatatacccaatatatcattgaggtgtctgctagtacactcaaaggtgaaggagttcggagtgctcccataagtatactgacggaggaagatgctcctgattctccccctcaagacttctctgtaaaacagttgtctggtgtcacggtgaagttgtcatggcaaccacccctggagccaaatggaattatcctttattacacagtttatgtctggaatagatcatcattaaaaactattaatgtcactgaaacatcattggagttatcagatttggattataatgttgaatacagtgcttatgtaacagctagcaccagatttggtgatgggaaaacaagaagcaatatcattagctttcaaacaccagagggagcaccaagcgatcctcccaaagatgtttattatgcaaacctcagttcttcatcaataattcttttctggacacctccttcaaaacctaatgggattatacaatattactctgtttattacagaaatacttcaggtacttttatgcagaattttacactccatgaagtaaccaatgactttgacaatatgactgtatccacaattatagataaactgacaatattcagctactatacattttggttaacagcaagtacttcagttggaaatgggaataaaagcagtgacatcattgaagtatacacagatcaagacatacctgaagggtttgttggaaacctgacttacgaatccatttcgtcaactgcaataaatgtaagctgggtcccaccggctcaaccaaacggtctagtcttctactatgtttcactgatcttacagcagactcctcgccatgtgagaccacctcttgttacatatgagagaagcatatattttgataatctggaaaaatacactgattatatattaaaaattactccatcaacagaaaagggattctctgatacctatactgcccagctatacatcaagactgaagaagatgtcccagaaacttcaccaataatcaacacttttaaaaacctttcctctacctcagttctcttatcatgggatcccccagtaaagccaaatggtgcaataataagttatgatttaactttacaaggaccaaatgaaaattattctttcattacttctgataattacataatattggaagagctttcaccatttacattatatagcttttttgctgccgcaagaactagaaaaggacttggtccttccagtattcttttcttttacacagatgagtcagtgccgttagcacctccacaaaatttgactttaatcaactgtacttcagactttgtatggctgaaatggagcccaagtcctcttccaggtggtattgttaaagtatatagttttaaaattcatgaacatgaaactgacactatatattataagaatatatcaggatttaaaactgaagccaaacttgttggactggaaccagtcagcacctactctatccgtgtatctgcgttcaccaaagttggaaatggcaatcaatttagtaatgtagtaaaattcacaacccaagaatcagttccagatgtcgtgcagaatatgcagtgcatggcaactagctggcagtcagttttagtgaaatgggatccacccaaaaaggcaaatggaataataacgcagtatatggtaacagttgaaaggaattctacaaaagtttctccccaagatcacatgtacactttcataaagcttcttgccaatacctcatatgtctttaaagtaagagcttcaacctcagctggtgaaggtgatgaaagcacatgccatgtcagcacactacctgaaacagttcccagtgttcccacaaatattgctttttctgatgttcagtcaactagtgcaacattgacatggataagacctgacactatccttggctactttcaaaattacaaaattaccactcaacttcgtgctcaaaaatgcaaagaatgggaatccgaagaatgtgttgaatatcaaaaaattcaatacctctatgaagctcacttaactgaagagacagtatatggattaaagaaatttagatggtatagattccaagtggctgccagcaccaatgctggctatggcaatgcttcaaactggatttctacaaaaactctgcctggccctccagatggtcctcctgaaaatgttcatgtagtagcaacatcaccttttagcatcagcataagctggagtgaacctgctgtcattactggaccaacatgttatctgattgatgtcaaatcggtagataatgatgaatttaatatatccttcatcaagtcaaatgaagaaaataaaaccatagaaattaaagatttagaaatattcacaaggtattctgtagtgatcactgcatttactgggaacattagtgctgcatatgtagaagggaagtcaagtgctgaaatgattgttactactttagaatcagccccaaaggacccacctaacaacatgacatttcagaagataccagatgaagttacaaaatttcaattaacgttccttcctccttctcaacctaatggaaatatccaagtatatcaagctctggtttaccgagaagatgatcctactgctgtccagattcacaacctcagtattatacagaaaaccaacacattcgtcattgcaatgctagaaggactaaaaggtggacatacatacaatatcagtgtttacgcagtcaatagtgctggtgcaggtccaaaggttccgatgagaataaccatggatatcaaagctccagcacgaccaaaaaccaaaccaacccctatttatgatgccacaggaaaactgcttgtgacttcaacaacaattacaatcagaatgccaatatgttactacagtgatgatcatggaccaataaaaaatgtacaagtgcttgtgacagaaacaggagctcagcatgatggaaatgtaacaaagtggtatgatgcatattttaataaagcaaggccatattttacaaatgaaggctttcctaaccctccatgtacagaaggaaagacaaagtttagtggcaatgaagaaatctacatcataggtgctgataatgcatgcatgattcctggcaatgaagacaaaatttgcaatggaccactgaaaccaaaaaagcaatacttatttaaatttagagctacaaatattatgggacaatttactgactctgattattctgaccctgttaagactttaggggaaggactttcagaaagaaccgtagagatcattctttccgtcactttgtgtatcctttcaataattctccttggaacagctatttttgcatttgcaagaattcgacagaagcagaaagaaggtggcacatactctcctcaggatgcagaaattattgacactaaattgaagctggatcagctcatcacagtggcagacctggaactgaaggacgagagattaacgcggttacttagttatagaaaatccatcaagccaataagcaagaaatccttcctgcaacatgttgaagagctttgcacaaacaacaacctaaagtttcaagaagaattttcggaattaccaaaatttcttcaggatctttcttcaactgatgctgatctgccttggaatagagcaaaaaaccgcttcccaaacataaaaccatataataataacagagtaaagctgatagctgacgctagtgttccaggttcggattatattaatgccagctatatttctggttatttatgtccaaatgaatttattgctactcaaggtccactaccaggaacagttggagatttttggagaatggtgtgggaaaccagagcaaaaacattagtaatgctaacacagtgttttgaaaaaggacggatcagatgccatcagtattggccagaggacaacaagccagttactgtctttggagatatagtgattacaaagctaatggaggatgttcaaatagattggactatcagggatctgaaaattgaaaggcatggggattgcatgactgttcgacagtgtaactttactgcctggccagagcatggggttcctgagaacagcgcccctctaattcactttgtgaagttggttcgagcaagcagggcacatgacaccacacctatgattgttcactgcagtgctggagttggaagaactggagtttttattgctctggaccatttaacacaacatataaatgaccatgattttgtggatatatatggactagtagctgaactgagaagtgaaagaatgtgcatggtgcagaatctggcacagtatatctttttacaccagtgcattctggatctcttatcaaataagggaagtaatcagcccatctgttttgttaactattcagcacttcagaagatggactctttggacgccatggaaggtgatgttgagcttgaatgggaagaaaccactatgtaa

SEQ ID NO: 24733 - DNA, 7287 bp, Homo sapiens
cctcgcgccgcccgcccggcagcccggccggcgcgcgcacgccgcgagccgctggcgctcgggctccgctcggatcccatgcaacagccacgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcagaccaagctttttcccatcttcccacaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctga

SEQ ID NO: 24734 - DNA, 7233 bp, Homo sapiens
cctcgcgccgcccgcccggcagcccggccggcgcgcgcacgccgcgagccgctggcgctcgggctccgctcggatcccatgcaacagccacgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccaggagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctga

SEQ ID NO: 24735 - DNA, 6006 bp, Homo sapiens
cctcgcgccgcccgcccggcagcccggccggcgcgcgcacgccgcgagccgctggcgctcgggctccgctcggatcccatgcaacagccacgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccatctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctga

SEQ ID NO: 24736 - DNA, 7347 bp, Homo sapiens
cctcgcgccgcccgcccggcagcccggccggcgcgcgcacgccgcgagccgctggcgctcgggctccgctcggatcccatgcaacagccacgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcagaccaagctttttcccatcttcccacaggagccctgcagattgaaagcagtgaggaaaccgaccagggcaaatatgagtgtgtggccaccaacagcgccggcgtgcgctactcctcacctgccaacctctacgtgcgagtttggagaacagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccagattcaggcctcaggagccccctcagggagccggggtttcactttgaaagcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctga

SEQ ID NO: 24737 - DNA, 6093 bp, Homo sapiens
cctcgcgccgcccgcccggcagcccggccggcgcgcgcacgccgcgagccgctggcgctcgggctccgctcggatcccatgcaacagccacgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcagaccaagctttttcccatcttcccacaggagccctgcagattgaaagcagtgaggaaaccgaccagggcaaatatgagtgtgtggccaccaacagcgccggcgtgcgctactcctcacctgccaacctctacgtgcgagtttggagaacagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccatctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccagattcaggcctcaggagccccctcagggagccggggtttcactttgaaagcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctga

SEQ ID NO: 24738 - DNA, 7320 bp, Homo sapiens
cctcgcgccgcccgcccggcagcccggccggcgcgcgcacgccgcgagccgctggcgctcgggctccgctcggatcccatgcaacagccacgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcagaccaagctttttcccatcttcccacaggagccctgcagattgaaagcagtgaggaaaccgaccagggcaaatatgagtgtgtggccaccaacagcgccggcgtgcgctactcctcacctgccaacctctacgtgcgagtttggagaacagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccaggagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccagattcaggcctcaggagccccctcagggagccggggtttcactttgaaagcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctga

SEQ ID NO: 24739 - DNA, 7347 bp, Homo sapiens
cctcgcgccgcccgcccggcagcccggccggcgcgcgcacgccgcgagccgctggcgctcgggctccgctcggatcccatgcaacagccacgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcagaaacctttgaaagcactccgattcgaggagccctgcagattgaaagcagtgaggaaaccgaccagggcaaatatgagtgtgtggccaccaacagcgccggcgtgcgctactcctcacctgccaacctctacgtgcgagagcttcgagaagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccagattcaggcctcaggagccccctcagggagccggggtttcactttgaaagcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctga

SEQ ID NO: 24740 - DNA, 7350 bp, Homo sapiens
cctcgcgccgcccgcccggcagcccggccggcgcgcgcacgccgcgagccgctggcgctcgggctccgctcggatcccatgcaacagccacgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgacgttcagaaacctttgaaagcactccgattcgaggagccctgcagattgaaagcagtgaggaaaccgaccagggcaaatatgagtgtgtggccaccaacagcgccggcgtgcgctactcctcacctgccaacctctacgtgcgagagcttcgagaagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaagaagccccatagtaaacgcaaggactcagaaccccgcaccaaatgcctcctgaacaatgccgacctcgcccctcaccaccccaaggaccctgtggaaatgagacgcattaacttccagactccagattcaggcctcaggagccccctcagggagccggggtttcactttgaaagcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctga

SEQ ID NO: 24741 - DNA, 4836 bp, Homo sapiens
cctcgcgccgcccgcccggcagcccggccggcgcgcgcacgccgcgagccgctggcgctcgggctccgctcggatcccatgcaacagccacgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccatctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccagattcaggcctcaggagccccctcagggagccggggtttcactttgaaagcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagagacggagtctcgcccaggctggagtgcagtggctcaatctcggctcactgcaagctccgcctcctggattcacgccattctcctgcctcagcctcccgagtggctgggactacaggtg

SEQ ID NO: 24742 - DNA, 6018 bp, Homo sapiens
cctcgcgccgcccgcccggcagcccggccggcgcgcgcacgccgcgagccgctggcgctcgggctccgctcggatcccatgcaacagccacgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagctctccgagaagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccatctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctga

SEQ ID NO: 24743 - DNA, 5579 bp, Homo sapiens
gccgcgccgctccgctccggctcgggctccggctcgcctcgggctgggctcgggctccgggggcggcgtcccccgcgccgggccccgggacgggcggcgacgctccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggagcaagtgcgaatccaccctggcacccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacagcccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcggccgaggccgaacgcttcctcttgcaacggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagccaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatctcagaggagggaggacaggttaccacaggtcaaaccacttcatagccactcaagggccgaagcctgagatggtctatgacttctggcgtatggtgtggcaggagcactgttccagcatcgtcatgatcaccaagctggtcgaggtgggcagggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggaaccgcgacaagaaccgcagcatggacgtcctgccgcccgaccgctgcctgcccttcctcatctccactgatggggactccaacaactacattaatgcagccctgactgacagctacacacggagtgcggccttcatcgtgaccctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatagcggggccctggcctggggcacccactgcacactcagggccagacccaccatcctggactggcgaggaagatcagtgcctcctgctctgcccaaacacactcccatggggcaagcactggagtggatgctgggctatcttgctcccccttccactgtgggcagggcctttcgcttgtcccatgggcgggtggtgggccaaggaggagcttagcaagtctgcagcccagccccacctccatagggtcctgcaggcctgtgctgagaggcctggtgctgcctggcagagtgacaaaggctcaggacggctggctctgggggactcaggccaagccccttggcaccatcctggcttttggcagggatgagtgaggccctgcagagagcatcccaggccaaggttcccactcagcctgccccctctgcatgtgggtagaggatgtactgggacttggcatttaggattccatctggcccagcccctgaaggtcctggggaagcaggtctcaattctgaatagccagtggggcacactgactgtcctccccaggggaactgcagcgccctcctccccactgccccctgcagcccctgagatattttgctcactatccctccccacttgcttccctgatatgtgctctgagcttccctgaaccaggatctgcctattactgctgtgccccatggggggctccttccctgcctgacccactgttgcagaatgaagtcacctcgcccccctcttcctttaatcttcaggcctcactggcctgtcctgctcagcttgggccagtgacaatctgcaaggctgaacaacagcccctggggttgaggcccctgtggctcctggtcaggctgcccgttgtggggaggggcagtgttagagcagggctggtcataccctctggagttcagaggaagaggtaggaccagtgcttttttgtttcttttgttatttttggttgggtgggtgggaaggtctctttaaaatggggcaggccacacccccattccgtgcctcaatttccccatctgtaaactgtagatatgactactgacctacctcgcagggggctgtggggaggcataagctgatgtttgtaaagcgctttgtaaataaacgtgctctctgaatgccac

SEQ ID NO: 24744 - DNA, 4470 bp, Homo sapiens
ggcgccagtcccgctccgcgccgcgccgctccgctccggctcgggctccggctcgcctcgggctgggctcgggctccgggggcggcgtcccccgcgccgggccccgggacgggcggcgacgctccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggagcaagtgcgaatccaccctggcacccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacagcccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcggccgaggccgaacgcttcctcttgcaacggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagccaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggagagaccactatgcctactcctactacccgaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatggttaccacaggtcaaaccacttcatagccactcaagggccgaagcctgagatggtctatgacttctggcgtatggtgtggcaggagcactgttccagcatcgtcatgatcaccaagctggtcgaggtgggcagggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggaaccgcgacaagaaccgcagcatggacgtcctgccgcccgaccgctgcctgcccttcctcatctccactgatggggactccaacaactacattaatgcagccctgactgacagctacacacggagtgcggccttcatcgtgaccctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatag

SEQ ID NO: 24745 - DNA, 5579 bp, Homo sapiens
gccgcgccgctccgctccggctcgggctccggctcgcctcgggctgggctcgggctccgggggcggcgtcccccgcgccgggccccgggacgggcggcgacgctccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggagcaagtgcgaatccaccctggcacccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacagcccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcggccgaggccgaacgcttcctcttgcaacggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagccaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatattcggataaaccgagaaggttaccacaggtcaaaccacttcatagccactcaagggccgaagcctgagatggtctatgacttctggcgtatggtgtggcaggagcactgttccagcatcgtcatgatcaccaagctggtcgaggtgggcagggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggaaccgcgacaagaaccgcagcatggacgtcctgccgcccgaccgctgcctgcccttcctcatctccactgatggggactccaacaactacattaatgcagccctgactgacagctacacacggagtgcggccttcatcgtgaccctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatagcggggccctggcctggggcacccactgcacactcagggccagacccaccatcctggactggcgaggaagatcagtgcctcctgctctgcccaaacacactcccatggggcaagcactggagtggatgctgggctatcttgctcccccttccactgtgggcagggcctttcgcttgtcccatgggcgggtggtgggccaaggaggagcttagcaagtctgcagcccagccccacctccatagggtcctgcaggcctgtgctgagaggcctggtgctgcctggcagagtgacaaaggctcaggacggctggctctgggggactcaggccaagccccttggcaccatcctggcttttggcagggatgagtgaggccctgcagagagcatcccaggccaaggttcccactcagcctgccccctctgcatgtgggtagaggatgtactgggacttggcatttaggattccatctggcccagcccctgaaggtcctggggaagcaggtctcaattctgaatagccagtggggcacactgactgtcctccccaggggaactgcagcgccctcctccccactgccccctgcagcccctgagatattttgctcactatccctccccacttgcttccctgatatgtgctctgagcttccctgaaccaggatctgcctattactgctgtgccccatggggggctccttccctgcctgacccactgttgcagaatgaagtcacctcgcccccctcttcctttaatcttcaggcctcactggcctgtcctgctcagcttgggccagtgacaatctgcaaggctgaacaacagcccctggggttgaggcccctgtggctcctggtcaggctgcccgttgtggggaggggcagtgttagagcagggctggtcataccctctggagttcagaggaagaggtaggaccagtgcttttttgtttcttttgttatttttggttgggtgggtgggaaggtctctttaaaatggggcaggccacacccccattccgtgcctcaatttccccatctgtaaactgtagatatgactactgacctacctcgcagggggctgtggggaggcataagctgatgtttgtaaagcgctttgtaaataaacgtgctctctgaatgccac

SEQ ID NO: 24746 - DNA, 5579 bp, Homo sapiens
ggcgccagtcccgctccgcgccgcgccgctccgctccggctcgggctccggctcgcctcgggctgggctcgggctccgggggcggcgtcccccgcgccgggccccgggacgggcggcgacgctccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggagcaagtgcgaatccaccctggcacccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacagcccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcggccgaggccgaacgcttcctcttgcaacggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagccaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatggttaccacaggtcaaaccacttcatagccactcaagggccgaagcctgagatggtctatgacttctggcgtatggtgtggcaggagcactgttccagcatcgtcatgatcaccaagctggtcgaggtgggcagggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggaaccgcgacaagaaccgcagcatggacgtcctgccgcccgaccgctgcctgcccttcctcatctccactgatggggactccaacaactacattaatgcagccctgactgacagctacacacggagtgcggccttcatcgtgaccctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatagcggggccctggcctggggcacccactgcacactcagggccagacccaccatcctggactggcgaggaagatcagtgcctcctgctctgcccaaacacactcccatggggcaagcactggagtggatgctgggctatcttgctcccccttccactgtgggcagggcctttcgcttgtcccatgggcgggtggtgggccaaggaggagcttagcaagtctgcagcccagccccacctccatagggtcctgcaggcctgtgctgagaggcctggtgctgcctggcagagtgacaaaggctcaggacggctggctctgggggactcaggccaagccccttggcaccatcctggcttttggcagggatgagtgaggccctgcagagagcatcccaggccaaggttcccactcagcctgccccctctgcatgtgggtagaggatgtactgggacttggcatttaggattccatctggcccagcccctgaaggtcctggggaagcaggtctcaattctgaatagccagtggggcacactgactgtcctccccaggggaactgcagcgccctcctccccactgccccctgcagcccctgagatattttgctcactatccctccccacttgcttccctgatatgtgctctgagcttccctgaaccaggatctgcctattactgctgtgccccatggggggctccttccctgcctgacccactgttgcagaatgaagtcacctcgcccccctcttcctttaatcttcaggcctcactggcctgtcctgctcagcttgggccagtgacaatctgcaaggctgaacaacagcccctggggttgaggcccctgtggctcctggtcaggctgcccgttgtggggaggggcagtgttagagcagggctggtcataccctctggagttcagaggaagaggtaggaccagtgcttttttgtttcttttgttatttttggttgggtgggtgggaaggtctctttaaaatggggcaggccacacccccattccgtgcctcaatttccccatctgtaaactgtagatatgactactgacctacctcgcagggggctgtggggaggcataagctgatgtttgtaaagcgctttgtaaataaacgtgctctctgaatgcca

SEQ ID NO: 24747 - DNA, 5550 bp, Homo sapiens
ctccggctcgggctccggctcgcctcgggctgggctcgggctccgggggcggcgtcccccgcgccgggccccgggacgggcggcgacgctccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggagcaagtgcgaatccaccctggcacccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacagcccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcggccgaggccgaacgcttcctcttgcaacggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagccaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatggttaccacaggtcaaaccacttcatagccactcaagggccgaagcctgagatggtctatgacttctggcgtatggtgtggcaggagcactgttccagcatcgtcatgatcaccaagctggtcgaggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggaaccgcgacaagaaccgcagcatggacgtcctgccgcccgaccgctgcctgcccttcctcatctccactgatggggactccaacaactacattaatgcagccctgactgacagctacacacggagtgcggccttcatcgtgaccctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatagcggggccctggcctggggcacccactgcacactcagggccagacccaccatcctggactggcgaggaagatcagtgcctcctgctctgcccaaacacactcccatggggcaagcactggagtggatgctgggctatcttgctcccccttccactgtgggcagggcctttcgcttgtcccatgggcgggtggtgggccaaggaggagcttagcaagtctgcagcccagccccacctccatagggtcctgcaggcctgtgctgagaggcctggtgctgcctggcagagtgacaaaggctcaggacggctggctctgggggactcaggccaagccccttggcaccatcctggcttttggcagggatgagtgaggccctgcagagagcatcccaggccaaggttcccactcagcctgccccctctgcatgtgggtagaggatgtactgggacttggcatttaggattccatctggcccagcccctgaaggtcctggggaagcaggtctcaattctgaatagccagtggggcacactgactgtcctccccaggggaactgcagcgccctcctccccactgccccctgcagcccctgagatattttgctcactatccctccccacttgcttccctgatatgtgctctgagcttccctgaaccaggatctgcctattactgctgtgccccatggggggctccttccctgcctgacccactgttgcagaatgaagtcacctcgcccccctcttcctttaatcttcaggcctcactggcctgtcctgctcagcttgggccagtgacaatctgcaaggctgaacaacagcccctggggttgaggcccctgtggctcctggtcaggctgcccgttgtggggaggggcagtgttagagcagggctggtcataccctctggagttcagaggaagaggtaggaccagtgcttttttgtttcttttgttatttttggttgggtgggtgggaaggtctctttaaaatggggcaggccacacccccattccgtgcctcaatttccccatctgtaaactgtagatatgactactgacctacctcgcagggggctgtggggaggcataagctgatgtttgtaaagcgctttgtaaataaacgtgctctctgaatgccacagagcagccctg

SEQ ID NO: 24748 - DNA, 8175 bp, Homo sapiens
aggagccgcggcgcgcacagccgggctggagcgcgcacccggcactgaggcttcgctgctctcggagcgctcagaccgcggccgccgcagccggcgaaagaggcaaagtcccgcacgccggaggacatgcgcctcggctagcggccccgggccccaccaccgtgcggctttctccagattattcctctctcgctgtctctgactgtctctctctgtctctgtctctgtctctctctctctcacacacacacacacacacacaaacacacatacgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgatgacagaggtagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 24749 - DNA, 771 bp, Homo sapiens
ggctgcgccgagccccctgcgcgctgcacatggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcgagcggaggcgcctgggggtcttggccaccgcctggctcaccttctacgacatcgccatgaccgcggggagactcattctgtcgcccaggctggagtgcattggcgcgatctccgctcactgccaacctcagcctccggagttcaagcgattctcctgcctcggcctccggagtagctgggactacaagcgtgggccaccacgccccattaatttttgtatttttggtagagacagggtatcaccatgttggccagggtggtctcgaactcctgacctcaaatgattcccccacttcggcctcccaatgtgctgggattacaggtgtgagccatcgcaccgggcctaatattttattttaattttttaaaaatagagatggcctctcactgtgttggctaggctggtctcaaactcccggcctcaagcaatcctcccacctcaacctccaaaagtgctgggattaccacttccggcttaatattttaaactttctccagggtttatagaaaaatgtgattgacaaaaatttaataaatctttacctatggtga

SEQ ID NO: 24750 - DNA, 1310 bp, Homo sapiens
ggtagagctggctgcgccgagccccctgcgcgctgcacatggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcgagcggaggcgcctgggggtcttggccaccgcctggctcaccttctacgacatcgccatgaccgcggggtggttggttctagctattgccatggtacgtttttatatggaaaaaggaacacacagaggtttatataaaagtattcagaagacacttaaatttttccagacatttgccttgcttgagatagttcactgtttaattggaattgtacctacttctgtgattgtgactggggtccaagtgagttcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagatataatttttttatcatcttatatcctgttggagttgctggtgaacttcttacaatatacgctgccttgccgcatgtgaagaaaacaggaatgttttcaataagacttcctaacaaatacaatgtctcttttgactactattattttcttcttataaccatggcatcatatatacctttgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaaatatcatggattgtatggtttcttaaaatataacttgagacacgtggtatttgccagtatttgtgttcctcttgtgccagatctattttttacaagaactgtgcaaatatcagtaacttttgggtaggtattgattattaggaaaataattaggtgtattatctgggggaaaaaaaaacttttgctaagttttttttgaaacatgctcaaagctttttaaatcaatatttagaaattagtttaacgatttactattatacctgctagtgatatttatgtgatatttataaatgaaaataaatgcaaaattataacaa

SEQ ID NO: 24751 - DNA, 1551 bp, Homo sapiens
ggtgggaatggcaggctgcgtcccactgctccagggcctggtcctggtcctcgccctccatcgtgtggagccctcagccacttcactgaaggaacgacatggactccattctgactctgcctgcacaggcgtccaggaaagcttatttctcccggcctccaaagcaaacgacgttctggtgaggtggaagcgtgcgggctcctatcttctggaagaactcttcgagggaaacttggaaaaagaatgttatgaagaaatctgtgtctatgaagaagcaagagaagtgtttgaaaatgaagtagtcactgatgaattctggagacgatataagggcggctccccgtgcatctcccagccctgcctccacaacggctcttgccaggacagcatctggggctacacctgcacctgctcccccggctatgagggcagcaactgcgagctggctaaaaatgaatgtcacccagagcggactgatgggtgtcaacacttctgcctcccaggacaggaatcctacacatgcagctgtgctcagggctacaggcttggtgaggaccacaaacagtgtgtgccccacgaccagtgtgcctgcggggtgctgacctctgagaagcgtgcaccggatctacaggacctcccgtggcaggtaaagttaacaaattccgaaggaaaagacttctgtggtggtgttataatacgggaaaattttgtactgacaacagcaaaatgttcactgttacacaggaatattactgtaaaaacatattttaacagaacgagccaagacccgctgatgatcaagataacgcacgtccatgtgcacatgcggtatgacgcggacgcgggggagaatgacctgtcactgctggagctggagtggcccatccagtgcccaggtgcggggctccccgtgtgcacccctgagaaagacttcgctgagcacctcctcatcccacgcaccaggggcctcctcagcggctgggcacgcaatggcactgacctgggcaactcgctgaccacgcggcctgtcacacttgtggagggggaggagtgcgggcaggtcctgaatgtgactgtcaccaccaggacctactgtgagagaagcagcgtggcggccatgcactggatggatggaagtgtggtcaccagagaacacagaggctcctggtttctcacgggggtcctgggctcgcagccagtaggagggcaggctcacatggtccttgtcaccaaggtctccaggtactcactctggtttaaacagatcatgaactaactgaaactcagctagccagaatgaacaacacaaccggaagcgggattccaagctggcactgccactgtggagggcgctgaaacttcatcacacactgagaggccgtcacagccccagaccacccgcttggcccacgcagcagcagagccgccgtttgctgggttgtttaccgagcactgtgacctttctttccctggaactctttatctcaatagagaccttaaaagaaaacatgagatacgttaaataataaaataagataatctgtcagtcat

SEQ ID NO: 24752 - DNA, 1485 bp, Homo sapiens
ggtgggaatggcaggctgcgtcccactgctccagggcctggtcctggtcctcgccctccatcgtgtggagccctcagtatttctcccggcctccaaagcaaacgacgttctggtgaggtggaagcgtgcgggctcctatcttctggaagaactcttcgagggaaacttggaaaaagaatgttatgaagaaatctgtgtctatgaagaagcaagagaagtgtttgaaaatgaagtagtcactgatgaattctggagacgatataagggcggctccccgtgcatctcccagccctgcctccacaacggctcttgccaggacagcatctggggctacacctgcacctgctcccccggctatgagggcagcaactgcgagctggctaaaaatgaatgtcacccagagcggactgatgggtgtcaacacttctgcctcccaggacaggaatcctacacatgcagctgtgctcagggctacaggcttggtgaggaccacaaacagtgtgtgccccacgaccagtgtgcctgcggggtgctgacctctgagaagcgtgcaccggatctacaggacctcccgtggcaggtaaagttaacaaattccgaaggaaaagacttctgtggtggtgttataatacgggaaaattttgtactgacaacagcaaaatgttcactgttacacaggaatattactgtaaaaacatattttaacagaacgagccaagacccgctgatgatcaagataacgcacgtccatgtgcacatgcggtatgacgcggacgcgggggagaatgacctgtcactgctggagctggagtggcccatccagtgcccaggtgcggggctccccgtgtgcacccctgagaaagacttcgctgagcacctcctcatcccacgcaccaggggcctcctcagcggctgggcacgcaatggcactgacctgggcaactcgctgaccacgcggcctgtcacacttgtggagggggaggagtgcgggcaggtcctgaatgtgactgtcaccaccaggacctactgtgagagaagcagcgtggcggccatgcactggatggatggaagtgtggtcaccagagaacacagaggctcctggtttctcacgggggtcctgggctcgcagccagtaggagggcaggctcacatggtccttgtcaccaaggtctccaggtactcactctggtttaaacagatcatgaactaactgaaactcagctagccagaatgaacaacacaaccggaagcgggattccaagctggcactgccactgtggagggcgctgaaacttcatcacacactgagaggccgtcacagccccagaccacccgcttggcccacgcagcagcagagccgccgtttgctgggttgtttaccgagcactgtgacctttctttccctggaactctttatctcaatagagaccttaaaagaaaacatgagatacgttaaataataaaataagataatctgtcagtcat

SEQ ID NO: 24753 - DNA, 1001 bp, Homo sapiens
cgtgggtgcaccctggaccccaccatggctcaccggccccccagccctgccctggcgtccgtgctgctggccttgctgctgagcggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacataccccagcgcctggtgaacgtggtgctcggagcccacaacgtgcggacgcaggagcccacccagcagcacttctcggtggctcaggtgtttctgaacaactacgacgcggagaacaaactgaacgacgttctcctcatccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactcc

SEQ ID NO: 24754 - DNA, 1041 bp, Homo sapiens
aggcactgaccgggttgcagatcgggagacggaggctcggagaggcccaggggctgctctgccatcccccctttccctgcagcctgggggctccctgacgcctggactccccccctgcaggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacataccccagcgcctggtgaacgtggtgctcggagcccacaacgtgcggacgcaggagcccacccagcagcacttctcggtggctcaggtgtttctgaacaactacgacgcggagaacaaactgaacgacgttctcctcatccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactccccctg

SEQ ID NO: 24755 - DNA, 1293 bp, Homo sapiens
ccgccatcccgccgtcccgctcggtgaccggagacacagccgggaacgcgactgatcaggctaccgagccgggccgcagggcgaaagcggtgcggtccgaggcctcagaaagggacacgcagcagcggaagtggcgctgactcagcccggcctccctgcagtcccctggcagcggtagcagccacaggggcgggcggctgggccacacgcctcccccgccctcggccccacccggccgcaccctaagccgcgcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaaggtgaaagggtgtggattttaagacattagactacaagagctgtttttggttgtcacctttatgctcctccattataacgtcagaaattcattacattaaaaatgtgaaaaatgt

SEQ ID NO: 24756 - DNA, 1733 bp, Homo sapiens
gcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggc

SEQ ID NO: 24757 - DNA, 1938 bp, Homo sapiens
cccgccatcccgccgtcccgctcggtgaccggagacacagccgggaacgcgactgatcaggctaccgagccgggccgcagggcgaaagcggtgcggtccgaggcctcagaaagggacacgcagcagcggaagtggcgctgactcagcccggcctccctgcagtcccctggcagcggtagcagccacaggggcgggcggctgggccacacgcctcccccgccctcggccccacccggccgcaccctaagccgcgcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggc

SEQ ID NO: 24758 - DNA, 1984 bp, Homo sapiens
ccgccatcccgccgtcccgctcggtgaccggagacacagccgggaacgcgactgatcaggctaccgagccgggccgcagggcgaaagcggtgcggtccgaggcctcagaaagggacacgcagcagcggaagtggcgctgactcagcccggcctccctgcagtcccctggcagcggtagcagccacaggggcgggcggctgggccacacgcctcccccgccctcggccccacccggccgcaccctaagccgcgcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggc

SEQ ID NO: 24759 - DNA, 930 bp, Homo sapiens
gcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcagtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagc

SEQ ID NO: 24760 - DNA, 2912 bp, Homo sapiens
gtctggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtctttacccctgaactaagacacagggagtatttcagaggccagcgtaggagtcattgacaacaaaaagccgagaacccagggccagcagtggagcctcagcagaccagggcctggtccttgctaactgctgcagggtggagtttgatctggcagacccgatcctccttcatgaacacccagcaacctgagcaagtcccggccctgccctcagcgagcccggcaggcgtcctgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcgtttgta

SEQ ID NO: 24761 - DNA, 2573 bp, Homo sapiens
gttgagcagggcggtgggtggtgcggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtgttatttaggaggattcgatggcaattttttgtggaacagaattggagcagtgtggttgcttttccagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtctttacccctgaactaagacacagggagtatttcagaggccagcgtaggagtcattgacaacaaaaagccgagaacccagggccagcagtggagcctcagcagacca

SEQ ID NO: 24762 - DNA, 1741 bp, Homo sapiens
tggcgaggaggagggtgcacttccccagcgaccctcggagcagcccggggtgctgtgggcattgggaaggaaggccagtaccagccccttatagcttccctcacttggggacttgtccctttgtctcaggctcaagaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtctttacccctgaactaagacacagggagtatttcagaggccagcgtaggagtcattgacaacaaaaagccgagaacccagggccagcagtggagcctcagcagaccagggcctggtccttgctaactgctgcagggtggagtttgatctggcagacccgatcctccttcatgaacacccagcaacctgagcaagtcccggccctgccctcagcgagcccggcaggcgtcctgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcgtttgta

SEQ ID NO: 24763 - DNA, 2652 bp, Homo sapiens
gtctggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatgtaagatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtctttacccctgaactaagacacagggagtatttcagaggccagcgtaggagtcattgacaacaaaaagccgagaacccagggccagcagtggagcctcagcagaccagggcctggtccttgctaactgctgcagggtggagtttgatctggcagacccgatcctccttcatgaacacccagcaacctgagcaagtcccggccctgccctcagcgagcccggcaggcgtcctgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactgg

SEQ ID NO: 24764 - DNA, 3123 bp, Homo sapiens
cccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtaggtgctgatgtccagtgctgcatgaggccggcctgtatggggcagatgcagatgtcacagggggtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtctttacccctgaactaagacacagggagtatttcagaggccagcgtaggagtcattgacaacaaaaagccgagaacccagggccagcagtggagcctcagcagaccagggcctggtccttgctaactgctgcagggtggagtttgatctggcagacccgatcctccttcatgaacacccagcaacctgagcaagtcccggccctgccctcagcgagcccggcaggcgtcctgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcgtttgta

SEQ ID NO: 24765 - DNA, 3038 bp, Homo sapiens
gaacgttgagcagggcggtgggtggtgcggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtctttacccctgaactaagacacagggagtatttcagaggccagcgtaggagtcattgacaacaaaaagccgagaacccagggccagcagtggagcctcagcagaccagggcctggtccttgctaactgctgcagggtggagtttgatctggcagacccgatcctccttcatgaacacccagcaacctgagcaagtcccggccctgccctcagcgagcccggcaggcgtcctgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcgtttgta

SEQ ID NO: 24766 - DNA, 2821 bp, Homo sapiens
acgcgcgctgctgcccgtctggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcgggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtctttacccctgaactaagacacagggagtatttcagaggccagcgtaggagtcattgacaacaaaaagccgagaacccagggccagcagtggagcctcagcagaccagggcctggtccttgctaactgctgcagggtggagtttgatctggcagacccgatcctccttcatgaacacccagcaacctgagcaagtcccggccctgccctcagcgagcccggcaggcgtcctgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcgtttgta

SEQ ID NO: 24767 - DNA, 847 bp, Homo sapiens
cggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtgttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatgtaagatatgagaacggccgaggcagctcccaccagcaacaggtgacctgttaccccttcaaagatgtcaataactggtggattgtaaagga

SEQ ID NO: 24768 - DNA, 812 bp, Homo sapiens
cggtgggtggtgcggagtgccgagcggcctcacccccaaccgtcggcccagtcggacggttccgaggcgttgccgggagccgggcgcggctctgtgtggactcggagaaacgcgggtacatttggggacaccggggacgagagcccagcccggacttgggggagtccgtcagtgccggacgcgggtccctggcttgcggacgggctggggccgggggcgtccccgtctttccggagctgggggcggggttcgggcccgggcagatgcggcgttcgggcggccgagccccgaagtaagaactccgtggcgcgtgcagccctagggaggaagggcgtgctgcgggtgcagtctcaggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcg

SEQ ID NO: 24769 - DNA, 2189 bp, Homo sapiens
gaacgttgagcagggcggtgggtggtgcggagtgccgagcggcctcacccccaaccgtcggcccagtcggacggttccgaggcgttgccgggagccgggcgcggctctgtgtggactcggagaaacgcgggttatttaggaggattcgatggcaattttttgtggaacagaattggagcagagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtctttacccctgaactaagacacagggagtatttca

SEQ ID NO: 24770 - DNA, 3320 bp, Homo sapiens
acgcgcgctgctgcccgtctggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcgggtacatttggggacaccggggacgagagcccagcccggacttgggggagtccgtcagtgccggacgcgggtccctggcttgcggacgggctggggccgggggcgtccccgtctttccggagctgggggcggggttcgggcccgggcagatgcggcgttcgggcggccgagccccgaagtaagaactccgtggcgcgtgcagccctagggaggaagggcgtgctgcgggtgcagtctcaggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtctttacccctgaactaagacacagggagtatttcagaggccagcgtaggagtcattgacaacaaaaagccgagaacccagggccagcagtggagcctcagcagaccagggcctggtccttgctaactgctgcagggtggagtttgatctggcagacccgatcctccttcatgaacacccagcaacctgagcaagtcccggccctgccctcagcgagcccggcaggcgtcctgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcgtttgta

SEQ ID NO: 24771 - DNA, 691 bp, Homo sapiens
gtcggacggttccgaggcgttgccgggagccgggcgcggctctgtgtggactcggagaaacgcgggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagag

SEQ ID NO: 24772 - DNA, 1168 bp, Homo sapiens
gtctggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcgggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtaggtgctgatgtccagtgctgcatgaggccggcctgtatggggcagatgcagatgtcacagggggtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacac

SEQ ID NO: 24773 - DNA, 791 bp, Homo sapiens
ccgagcggcctcacccccaaccgtcggcccagtcggacggttccgaggcgttgccgggagccgggcgcggctctgtgtggactcggagaaacgcggttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtaggtgctgatgtccagtgctgcatgaggccggcctgtatggggcagatgcagatgtcacagggggtctgtgtgttctgtcacttgctcgcccgagcagtggctttgctggtcatcc

SEQ ID NO: 24774 - DNA, 1587 bp, Homo sapiens
aacgttgagcagggcggtgggtggtgcggagtgccgagcggcctcacccccaaccgtcggcccagtcggacggttccgaggcgttgccgggagccgggcgcggctctgtgtggactcggagaaacgcgggttatttaggaggattcgatggcaattttttgtggaacagaattggagcaggtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcaggctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatg

SEQ ID NO: 24775 - DNA, 4876 bp, Homo sapiens
tgcgcctcctgccgcctcctagcggcccgggccgcgaccacgctgcccgccccgccccgagcccggggccccgcgctccgctgcagtgaagggcgttgcatttcccggggtaccccgagctgccctcttgtgactccttggcggggcggctggtcagacaaagtgtgcctccgggccggagggcgacccagaggagggggaagatgccgccggccacgggcggaggcctggcagagtccgagctgcgtccccggaggggccgctgtggcccccaggctgctagggccgcaggccgggacgtggccgctgaggctgtggcgcgaagccccaaacggcctgcttggggctcacggcgcttcgaggcggtcggctggtgggccctgctggccttggtgacgctgctgtccttcgccacccgcttccaccgcttggacgagccgccgcacatctgttgggatgagactcactttggaaaaatgggaagttactatatcaaccgtacatttttctttgatgtgcacccgcccctgggaaagatgctgataggtcttgctggctacctgagtggatatgatggtacctttttgttccagaagcctggggataaatatgagcatcacagctacatgggaatgagaggattctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcaggtcaccacctatttgcacaaggactacaacaacctgtggattatcaagaaacataacacaaactcagatcccctagacccttccttcccagtggagtttgtaagacatggagacattattcgactagaacacaaagaaacttcccggaacttgcacagtcactatcatgaggcccccatgacccggaagcactatcaggtcaccggctatggcataaatggaacaggggactcaaatgatttctggcggattgaggtcgtaaacaggaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcagggttgtcccaggtcctgcttcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaatattttctggtatttttttctgttggatttctttggttttggtttgtaagatccatcaaaaattctcagacctctgagagggccttgagggcagagaatactgacctcaccttgggatgtcaccaaaggcagagcagatgggactgtcaaagttgtgctgccctccctcccacaaacaaatgaatccagcgtggaggaaggcgcgccgccccgagctggagggcctggctcccaccatgccccccagtggctgcaggtagctggacttcctgcctgtgacgcacagagagcagcggactccggagcgtcagcctgccttagcccttggttcctcgttttttgggattgtcacactgtgacactcgggaggaacgatgtcctatcctgggctgctcagtgttcccaggccctgtgtgccagaggccaggtctctccaagtgcatctagcctggcctggagggcaaggcagatgcattctcctggctgctgggagagcccatgggaaccttgcttagcgcccaaggtagatgagagacagggcagggaatctgcgtggtgctgggatgtggggactctggcctctccagactaatgttcctgtcacctgctgagctttcccagtgtcacttctgcagtcctcctctgctcacccctccctcactccgtgggcaattccctttctctctgtcactgcttcagcagtgaagacccatggcacctagaaatgcatgccagcttcctgcgtctaccactctgcagctcaaacaagaagctcagagctgccccttccacttcctccccaaaagggatgaagaaaaccctgtggtagaaccaaaccacccaaggccagcccttaagcctgcctccaccttcctggtgcatgacaaaatatttcttttgtctcagaggactttgatgcttcaatatttaatgatgaatccgccacactccattttccctcctctgaagctcccaacaactctgacagggtcagatctctttaaagcatcttcaggaggcggttgccacggagactggatattggtcccagggacaggctgtgctacctactgggtggtggggagggaagcttctggccatgcttgggcattcagaccaaccatcattaatgttaatagaggaaatgcagcaacgtcaaaagcaaggcaggttggttaattagatctggggcccgatgacctccctttcccactgctacagcccttttgacttcccccagcaggaagcgctgtctgtgcggctgagtctgggccacttgcttaattgcatttctggcagggaaggagaggagggatggagaagctctgctcgctgcttccacctcaccgtgtgtcctcccctcccctcccttcctctcctccccacaggcggaattgctttcttctgagccgggtgggctctcctgcagggagaatgcaggggtctgtgcttggctcttagcaaagcaggtggcccacagtgacctccaggaggtggctgattttcctttgtgccttcttatttctcagtaggaacttggaagggaagagctctgaaggagccagaggggcagccaccttgcatgagggtgaggaaggagaagcccagccagcctctacccatccctccctcccaattaggctgcactggggccgaacgcttccctgggctcccactgccttctaaggagccaaggagaattccctgcccactttctgttcctccatgcccaaactggcagatgcttctctgggagcaaggccacatgggctgatgcagctttgagtgctcaggttctgttttctggaagttgctggagaagggctgtcagggtgcttctatgaatatgggcttcagctgtagcacttggcagaaacgtgatgtgtcccacaaactgctggtggaggaagaagatgttcgtcagccaattcaacctccagccagcttcttgagcctatttggtttaaaaaaaaaaagtcttctaatcagaagccactgattttataataaataacacttgttttgaa

SEQ ID NO: 24776 - DNA, 1424 bp, Homo sapiens
aggaagcaaagaaggacctgggctttgggaagatctaaagacccaggaaggtctctgggtgggataaagccaagatgaaactccccttacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcatactgggctgctcaccagccctggtcccgcggtggtcactgcgtggccctgtgtacccgaggaggccactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctctctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataa

SEQ ID NO: 24777 - DNA, 1367 bp, Homo sapiens
gctttgggaagatctaaagacccaggaaggtctctgggtgggtgagtgctttctctgctgtggtggagctggtgacagtttattctcccaggaggtccctggctgtggctgacagtttctggagggctggcaggcgtctacctgtggctttcaggataaagccaagatgaaactccccttacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcatactgggctgctcaccagccctggtcccgcggtggtcactgcgtggccctgtgtacccgaggaggccactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctctctctctccaaccccagaactgtggttggttttatatgtaaggaagttaacatgtccctgggaacagtccacaacattcaggaatgaatgtataagtaccgcaatccccggccc

SEQ ID NO: 24778 - DNA, 1350 bp, Homo sapiens
ggctttgggaagatctaaagacccaggaaggtctctgggtgggataaagccaagatgaaactccccttacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctgtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcatactgggctgctcaccagccctggtcccgcggtggtcactgcgtggccctgtgtacccgaggaggccactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctctctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttccta

SEQ ID NO: 24779 - DNA, 869 bp, Homo sapiens
agaggcactgagagtggaggtctcagactcttggaaggggctatactagacacacaaagacagccccaagaaggacggtggagtagtgtcctcgctaaaagacagtagatatgcaatgcctcttgctcctgccctttctcctgctgggaacagtttctgctcttcatctggagaatgatgccccccatctggagagcctagagacacaggcagacctaggccaggatctggatagttcaaaggagcaggagagagacttggctctgacggaggaggtgattcaggcagagggagaggaggtcaaggcttctgcctgtcaagacaactttgaggatgaggaagccatggagtcggacccagctgccttagacaaggacttccagtgccccagggaagaagacattgttgaagtgcagggaagtccaaggtgcaagatctgccgctacctattggtgcggactcctaaaacttttgcagaagctcagaatgtctgcagcagatgctacggaggcaaccttgtctctatccatgacttcaacttcaactatcgcattcagtgctgcactagcacagtcaaccaagcccaggtctggattggaggcaacctcaggggctggttcctgtggaagcggttttgctggactgatgggagccactggaattttgcttactggtccccagggcaacctgggaatgggcaaggctcctgtgtggccctatgcaccaaaggaggttattggcgacgagctcaatgcgacaagcaactgcccttcgtctgctccttctaagccagcggcacggagaccctgccagcagctccctcccgtcccccaacctctcctgctcataaatccagacttcccacagca

SEQ ID NO: 24780 - DNA, 4921 bp, Homo sapiens
atctatcctttacggcaagggtacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccactcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctgtgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggcttaaggatta

SEQ ID NO: 24781 - DNA, 3629 bp, Homo sapiens
aaactcatctatcctttacggcaagggtacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggctt

SEQ ID NO: 24782 - DNA, 4765 bp, Homo sapiens
atctatcctttacggcaagggtacctacggtacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccactcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctgtgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggcttaaggatta

SEQ ID NO: 24783 - DNA, 4913 bp, Homo sapiens
aaactcatctatcctttacggcaagggtacctacggtacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccactcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctgtgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggctt

SEQ ID NO: 24784 - DNA, 5044 bp, Homo sapiens
atctatcctttacggcaagggtacctacggtacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccactcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctgtgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggcttaaggatta

SEQ ID NO: 24785 - DNA, 3002 bp, Homo sapiens
caggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatgggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaa

SEQ ID NO: 24786 - DNA, 2897 bp, Homo sapiens
caggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacgtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatgggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaa

SEQ ID NO: 24787 - DNA, 3133 bp, Homo sapiens
atggcttctcacgcttgtgctgcatatcccacaccaattagacccaaggatcagttggaagtttccaggacatcttcattttatttccaccctcaatccacatttccagatgtctctgcagcaaagcgaaattccaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatgggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatc

SEQ ID NO: 24788 - DNA, 588 bp, Homo sapiens
aaggcaaaatcacaggaaaagttccaggagaccataccttccttctccggagtcttccaacaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagag

SEQ ID NO: 24789 - DNA, 1442 bp, Homo sapiens
agagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagc

SEQ ID NO: 24790 - DNA, 623 bp, Homo sapiens
gggctctggaggacctggaagataccctatgaggtctgtagggagccctcaggaaaggtctgctgacgaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcg

SEQ ID NO: 24791 - DNA, 587 bp, Homo sapiens
acttcatggcttctcacgcttgtgctgcatatcccacaccaattagacccaaggatcagttggaagtttccaggacatcttcattttatttccaccctcaatccacatttccagatgtctctgcagcaaagcgaaattccaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctt

SEQ ID NO: 24792 - DNA, 786 bp, Homo sapiens
agtcttctatgccagggctaggaaagctgccttccaaaatttggtctgggaagacattatcctgggaatgagaagcaaagcctcagctctagaagcccaaataatagcagatgacccaggctttcactggcacccagtacaggcagcaggctgcaccaagaaggctggcagtgcctcttgaggaatcccttggcagtgcaggagcctagctggactcaagaatattttgccaagggcacccagcagaaccaatggaagcagaatcacagaaataggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggg

SEQ ID NO: 24793 - DNA, 608 bp, Homo sapiens
agatgtctctgcagcaaagcgaaattccaggcaagccttagggaaaaaaggaaaaacaaagaaaatgaaacaattggcagtgaaaggcagaaagagaagatggagcccttagagaagggagtatccctgagagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaaggg

SEQ ID NO: 24794 - DNA, 580 bp, Homo sapiens
aatcttgcctttctcccaccccaggaaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagc

SEQ ID NO: 24795 - DNA, 620 bp, Homo sapiens
ctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtaaaggccatgggagcagctctgaagcacagagcgaagggtttgaggagccagggaccatttctgcctttgcttctggcagaaatcgtgtgacccacagcaagtcacacttgtcctcagacatggaggaaagtctggcccaggacttggttttgcctcccaaggtcttcatttgctgtgaagggaagtcccttgtcaga

SEQ ID NO: 24796 - DNA, 1079 bp, Homo sapiens
ctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaataaagtaatcctttcatcaaatgtgggtaaatttcaagcatcaggagggggaaatggagtggaaacagctggggcaaggaggcaaagaagccaggcctgttttacaacaaatattaaattacttcaataatacaaacgag

SEQ ID NO: 24797 - DNA, 1212 bp, Homo sapiens
cgcgtgagtcccccactggctgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctgagaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttcta

SEQ ID NO: 24798 - DNA, 811 bp, Homo sapiens
agactgactggctctttcttaatatttcggccctcgtccgcgcccgtcgtgcccctgcagggattggcgcgagtcaccttggcgtctccttaacccttgtgtccctggcgtcatctctgactctcccaggggcgacttcttggcagagcggagctcggggcccggatctccacaggggctctcagtgaccccttctggactcagtccgggaatgagtttgtggggtgagaacaccgtccccagtgcggggcctggctgttcgattttctccgaagcaccaaaaggtgacttcccgcgagggcgatgagtagtagcccgagaggcgcatccccgacagtctcggacctacgcagcccggtggactttggggcgacctcccgtgggacttggcccgccgaatgcagacattcgggcctgccggggtggcggcagtggggcgtcgagtcgagagcccggccgaccgacgcgcgacccgcgcgtgccactgcaagctctgcctgccggccgggagtctccaaggacttaaaggagaagaaggaagtgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagc

SEQ ID NO: 24799 - DNA, 1221 bp, Homo sapiens
ctggcgccgcgtgagtcccccactggctgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttctaacaaa

SEQ ID NO: 24800 - DNA, 4530 bp, Homo sapiens
acacactcggggagcgggagcgcggcgcggacgcaaagccgccgggctgctgcgcccagagccagccggagccggagccggagcccgaactgcagctccagccccagccgtgcggagccgcagcccaggccggggccggcggcggctcatggacagcggggcgggcggccggcgctgcccggaggcggccctcctgattctggggcctcccaggatggagcacctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatggcagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggctgggcctgaggcccaggagctatttgggctgcaggtggcagaggaccaggaggagaagcaaccacagctcattgtgatgggcaacctggaccgtgagcgctgggactcctatgacctcaccatcaaggtgcaggatggcggcagccccccacgcgccagcagtgccctgctgcgtgtcaccgtgcttgacaccaatgacaacgcccccaagtttgagcggccctcctatgaggccgaactatctgagaatagccccataggccactcggtcatccaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgctgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagaccctcctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggttaccaggctggtaagaaggagaccaaggacctgtatgcccccaagcccagtggcaaggcctccaagggaaacaaaagcaaaggcaagaagagcaagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcagttacctcaccgccgcgtcaccttctcggccaccagccaggcccaggagctgcaggacccatcccagcacagttactatgacagtggcctggaggagtctgagacgccgtccagcaagtcatcctcagggcctcgactcggtcccctggccctgcctgaggatcactatgagcgcaccacccctgatggcagcataggagagatggagcaccccgagaatgaccttcgccctttgcctgatgtcgccatgacaggcacatgtacccgggagtgcagtgagtttggccactctgacacatgctggatgcctggccagtcatctcccagccgccggaccaagagcagcgccctcaaactctccaccttcgtgccttaccaggaccgaggagggcaggagcctgcgggcgccggcagccccagccccccggaagaccggaacaccaaaacggcccccgtgcgcctcctgccctcctacagtgccttctcccacagtagccatgattcctgcaaggactcggccaccttggaggaaatccccctgacccagacctcggacttcccacccgcagccacaccggcatctgcccagacggccaagcgcgagatctacctgtgagccccctactggccggccggcccccctcccccagccgccggccagctcccaaatggcccattccagggcctcactctccaccccttcagcgtggacttcctggccagggccccaagtgggggtatcactgacctcatgaccacgctggcccttctcccatgcagggtccaggtcctctcccctcatttccatctcccagcccccaggggccccttcccctttatggggcttcccccatctgatgcccaagagggctcctctgcaatgactgggctccttcccttgacttccagggagcaccccctcgatttgggcagatggtggagtcaagggtgggcagcgtacttctaactcattgtttccctcatggccgaccagggcggggatagcatgcccaattttagccctgaagcagggctgaactggggagcccctttccctgggagctcccagaggaaactcttgaccaccagtggctccctgaagggcttttgttaccaaaggtggggtagggacgggggtgggagtggagcggaggccttgttttcccgtgctgctcctggactggcccacctgcctgccacatgcccacgcctagtcccatctgggcccccattccctgctggtcatgcagtgtctgtatataaggaccttggaatgacgtcccc

SEQ ID NO: 24801 - DNA, 3819 bp, Homo sapiens
ggggagcgggagcgcggcgcggacgcaaagccgccgggctgctgcgcccagagccagccggagccggagccggagcccgaactgcagctccagccccagccgtgcggagccgcagcccaggccggggccggcggcggctcatggacagcggggcgggcggccggcgctgcccggaggcggccctcctgattctggggcctcccaggatggagcacctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatggcagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggctgggcctgaggcccaggagctatttgggctgcaggtggcagaggaccaggaggagaagcaaccacagctcattgtgatgggcaacctggaccgtgagcgctgggactcctatgacctcaccatcaaggtgcaggatggcggcagccccccacgcgccagcagtgccctgctgcgtgtcaccgtgcttgacaccaatgacaacgcccccaagtttgagcggccctcctatgaggccgaactatctgagaatagccccataggccactcggtcatccaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgctgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagaccctcctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggttaccaggctggtaagaaggagaccaaggacctgtatgcccccaagcccagtggcaaggcctccaagggaaacaaaagcaaaggcaagaagagcaagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcaggtaggccagccctttcagctcagcacaccccagcccctaccccacccctaccacggagccatctggaccgaggtgtgggagtgatggagcaggtttactgtgcctgcccgtgttgggggccagcctgagccagcagtgggaggtggggccttagtgcctcaccgggcacacggattaggctgagtgaagattaagggagggtgtgctctgtggtctcctccctgccctctccccactggggagagacctgtgatttgccaagtccctggaccctggaccagctactgggccttatgggttgggggtggtaggcaggtgagcgtaagtggggagggaaatgggtaagaagtctactccaaacctaggtctctatgtcagaccagacctaggtgcttctctaggagggaaacagggagacctggggtcctgtggataactgagtggggagtctgccaggggagggcaccttcccattgtgccttctgtgtgtattgtgcattaacctcttcctcaccactaggcttctggggctgggtcccacatgcccttgaccctgacaataaagttctctatttttgga

SEQ ID NO: 24802 - DNA, 3769 bp, Homo sapiens
gcggcgcggacgcaaagccgccgggctgctgcgcccagagccagccggagccggagccggagcccgaactgcagctccagccccagccgtgcggagccgcagcccaggccggggccggcggcggctcatggacagcggggcgggcggccggcgctgcccggaggcggccctcctgattctggggcctcccaggatggagcacctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatggcagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggtggcagaggaccaggaggagaagcaaccacagctcattgtgatgggcaacctggaccgtgagcgctgggactcctatgacctcaccatcaaggtgcaggatggcggcagccccccacgcgccagcagtgccctgctgcgtgtcaccgtgcttgacaccaatgacaacgcccccaagtttgagcggccctcctatgaggccgaactatctgagaatagccccataggccactcggtcatccaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgctgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagaccctcctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggttaccaggctggtaagaaggagaccaaggacctgtatgcccccaagcccagtggcaaggcctccaagggaaacaaaagcaaaggcaagaagagcaagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcaggtaggccagccctttcagctcagcacaccccagcccctaccccacccctaccacggagccatctggaccgaggtgtgggagtgatggagcaggtttactgtgcctgcccgtgttgggggccagcctgagccagcagtgggaggtggggccttagtgcctcaccgggcacacggattaggctgagtgaagattaagggagggtgtgctctgtggtctcctccctgccctctccccactggggagagacctgtgatttgccaagtccctggaccctggaccagctactgggccttatgggttgggggtggtaggcaggtgagcgtaagtggggagggaaatgggtaagaagtctactccaaacctaggtctctatgtcagaccagacctaggtgcttctctaggagggaaacagggagacctggggtcctgtggataactgagtggggagtctgccaggggagggcaccttcccattgtgccttctgtgtgtattgtgcattaacctcttcctcaccactaggcttctggggctgggtcccacatgcccttgaccctgacaataaagttctctatttttgg

SEQ ID NO: 24803 - DNA, 3307 bp, Homo sapiens
ctgagtttctggaatcggggttctgtgctgggactgactgctcttgtggagaatcgtgtgtcagtgggagaggccctcctgattctggggcctcccaggatggagcacctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatggcagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggctgggcctgaggcccaggagctatttgggctgcaggtggcagaggaccaggaggagaagcaaccacagctcattgtgatgggcaacctggaccgtgagcgctgggactcctatgacctcaccatcaaggtgcaggatggcggcagccccccacgcgccagcagtgccctgctgcgtgtcaccgtgcttgacaccaatgacaacgcccccaagtttgagcggccctcctatgaggccgaactatctgagaatagccccataggccactcggtcatccaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgctgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagaccctcctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggttaccaggctggtaagaaggagaccaaggacctgtatgcccccaagcccagtggcaaggcctccaagggaaacaaaagcaaaggcaagaagagcaagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcaggtaggccagccctttcagctcagcacaccccagcccctaccccacccctaccacggagccatctggaccgaggtgtgggagtgatggagcaggtttactgtgcctgcccgtgttgggggccagcctgagccagcagtgggaggtggggccttagtgcctcaccgggcacacggat

SEQ ID NO: 24804 - DNA, 5366 bp, Homo sapiens
caggctcagaggctgaagcaggaggaaggaaggactggaaggaaaaagagacaggttagagggaaagaggcttgggaagaaaacagcagaaaagaaactgctcattacacttacagagaggcaagtaacggtggagatgaggacagagggaaccaagactctgaaagacaaaaaatacaaatagagcgaaagaggaaaaaaatgtcaagaagaacatccatccggagaaatgaagagaatgaaagttttaagctgcagagccgttctgtgcttttccggcacaaaattatatcgctgattttaagcccttttgcatttgccagccgttgacattaagaggcatgtttaacggtgccaacagcatctccttttccttctcctcttcctcttcttcttcttcctcctcctcctcctctttttcctcctcctcgttctcctcccatcagcaagaagacaaaccgaggacagtcttgaaatatcgaaatttcctctttgggatttgccagcgccaagactgtcggaataaaggacgctgactattgtattattgttattttattaattagtcagtggaaagattacagatgaggaaaggggacgcctgtcacccttcctgtgctaagatttaaaaaaaaatgaggctggattgcgggaagctctaaaatgaagcaaaaggagtaagatttttaaagacagaaagccacaggagcccccacgtagcgcacttttatttgtattttttcagatttttttttgtttcgtggtggtgggggaggtgattgggtggctgactggctgcgggaagctacttcctttccttttggagatgattgtgctattattgtttgccttgctctggatggtggaaggagtcttttcccagcttcactacacggtacaggaggagcaggaacatggcactttcgtggggaatatcgctgaagatctgggtctggacattacaaaactttcggctcgcgggtttcagacggtgcccaactcaaggaccccttacttagacctcaacctggagacaggggtgctgtacgtgaacgagaaaatagaccgcgaacaaatctgcaaacagagcccctcctgtgtcctgcacctggaggtctttctggagaaccccctggagctgttccaggtggagatcgaggtgctggacattaatgacaaccccccctctttcccggagccagacctgacggtggaaatctctgagagcgccacgccaggcactcgcttccccttggagagcgcattcgacccagacgtgggcaccaactccttgcgcgactacgagatcacccccaacagctacttctccctggacgtgcagacccagggggatggcaaccgattcgctgagctggtgctggagaagccactggaccgagagcagcaagcggtgcaccgctacgtgctgaccgcggtggacggaggaggtgggggaggagtaggagaaggagggggaggtggcgggggagcaggcctgcccccccagcagcagcgcaccggcacggccctactcaccatccgagtgctggactccaatgacaatgtgcccgctttcgaccaacccgtctacactgtgtccctaccagagaactctcccccaggcactctcgtgatccagctcaacgccaccgacccggacgagggccagaacggtgaggtcgtgtactccttcagcagccacatttcgccccgggcgcgggagcttttcggactctcgccgcgcactggcagactggaggtaagcggcgagttggactatgaagagagcccagtgtaccaagtgtacgtgcaagccaaggacctgggccccaacgccgtgcctgcgcactgcaaggtgctagtgcgagtactggatgctaatgacaacgcgccagagatcagcttcagcaccgtgaaggaagcggtgagtgagggcgcggcgcccggcactgtggtggcccttttcagcgtgactgaccgcgactcagaggagaatgggcaggtgcagtgcgagctactgggagacgtgcctttccgcctcaagtcttcctttaagaattactacaccatcgttaccgaagcccccctggaccgagaggcgggggactcctacaccctgactgtagtggctcgggaccggggcgagcctgcgctctccaccagtaagtcgatccaggtacaagtgtcggatgtgaacgacaacgcgccgcgtttcagccagccggtctacgacgtgtatgtgactgaaaacaacgtgcctggcgcctacatctacgcggtgagcgccaccgaccgggatgagggcgccaacgcccagcttgcctactctatcctcgagtgccagatccagggcatgagcgtcttcacctacgtttctatcaactctgagaacggctacttgtacgccctgcgctccttcgactatgagcagctgaaggacttcagttttcaggtggaagcccgggacgctggcagcccccaggcgctggctggtaacgccactgtcaacatcctcatagtggatcaaaatgacaacgcccctgccatcgtggcgcctctaccagggcgcaacgggactccagcgcgtgaggtgctgccccgctcggcggagccgggttacctgctcacccgcgtggccgccgtggacgcggacgacggcgagaacgcccggctcacttacagcatcgtgcgtggcaacgaaatgaacctctttcgcatggactggcgcaccggggagctgcgcacagcacgccgagtcccggccaagcgcgacccccagcggccttatgagctggtgatcgaggtgcgcgaccatgggcagccgcccctttcctccaccgccaccctggtggttcagctggtggatggcgccgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcctctgctgctgctgctgcggtggcggaggttcgacctgctgtggccgccaagcccgggcgcgcaagaagaaactcagcaagtcagacatcatgctggtgcagagctccaatgtacccagtaacccggcccaggtgccgatagaggagtccgggggctttggctcccaccaccacaaccagaattactgctatcaggtatgcctgacccctgagtccgccaagaccgacctgatgtttcttaagccctgcagcccttcgcggagtacggacactgagcacaacccctgcggggccatcgtcaccggttacaccgaccagcagcctgatatcatctccaacggaagcattttgtccaacgagactaaacaccagcgagcagagctcagctatctagttgacagacctcgccgagttaacagttctgcattccaggaagccgacatagtaagctctaaggacagtggtcatggagacagtgaacagggagatagtgatcatgatgccaccaaccgtgcccagtcagctggtatggatctcttctccaattgcactgaggaatgtaaagctctgggccactcagatcggtgctggatgccttcttttgtcccttctgatggacgccaggctgctgattatcgcagcaatctgcatgttcctggcatggactctgttccagacactgaggtgtttgaaactccagaagcccagcctggggcagagcggtccttttccacctttggcaaagagaaggcccttcacagcactctggagaggaaggagctggatggactgctgactaatacgcgagcgccttacaaaccaccatatttgacacggaaaaggatatgctagtcaattctacaggacttacctgaagcagcatgatttgcacaaagtcgaccaacaaaagcatcaacttttcaacttcattatcttggccatccagttagtcatgtgtaactgagtattagatttcggatggagtcatcatggccaattataggacctaattgctctcagcaggcctgagaaatgagttgaaatgtgcagaactgtagaaactttagaggcaacagattttgcctccccgatcagtgtgtgcctgtttacagcactatctatctttctctctccaaatgtcactgagccctttagatgtttatattcaccacgagaagccagtcataaagataaaggaaatttgtgcattataaatgcaatatcactgttttaaacttgactgttttatattatttttgtgtgatcaagtgttccgcaagctattccaactttacaagagaaattgtgattatgttcttttcacctgtgggttataaaaaatgttgtattctgaagacccacaaaatatcaaagacattctgtagtttatacaccgtgttgcaaagtgtttactgtactatttcaaagcttctaaataaatataaaatatatatattatattatataattttcctaaaatgtggtacaactcagttggtttttaaatggatgcatacagtccacatcatacaataaaataaaaggtaattcagggtcccaaagacaaacttactaagaaaaaatcattaatagttttctcccaatttccatatcttactcaaccgtgtttttccttgtttaaaagaaaatgatgctctaagctacaaaattttgtcaaaaactcatattgaattttcaatgccaaagatgtagctattgatgttatcagacagagcactgactatgtactatcaaactatctaacaatctgcataagtctgattctatttctatgactttgaatttagaatcacttaaagcttttataaagaatcgataaattcacctgtatttgttgttagaaaaaaactgggtgtctgtacattttgtggtgtaaaatatgtaattgaagattactattttaagaagtcatcagtcatatcactcacacagaattttattttacatagttttgtgacttaattacacatgaatataaaatctataattctatatgaatatatagagatatagaaacatctgaactggtaaagaataactataaaatatgaaagctctaaatttaaaataaatttagagatagaatcatggtacattattgtttcagtattccatgtgaaaattttatagcttaaatgtagtcagtgtttgattaatgaaaaaattcttcatgagtcagccttcaaaagttaagcttgccttttacttttatgtcaacaatattaattattaaatttagtaagacgca

SEQ ID NO: 24805 - DNA, 3946 bp, Homo sapiens
caggctcagaggctgaagcaggaggaaggaaggactggaaggaaaaagagacaggttagagggaaagaggcttgggaagaaaacagcagaaaagaaactgctcattacacttacagagaggcaagtaacggtggagatgaggacagagggaaccaagactctgaaagacaaaaaatacaaatagagcgaaagaggaaaaaaatgtcaagaagaacatccatccggagaaatgaagagaatgaaagttttaagctgcagagccgttctgtgcttttccggcacaaaattatatcgctgattttaagcccttttgcatttgccagccgttgacattaagaggcatgtttaacggtgccaacagcatctccttttccttctcctcttcctcttcttcttcttcctcctcctcctcctctttttcctcctcctcgttctcctcccatcagcaagaagacaaaccgaggacagtcttgaaatatcgaaatttcctctttgggatttgccagcgccaagactgtcggaataaaggacgctgactattgtattattgttattttattaattagtcagtggaaagattacagatgaggaaaggggacgcctgtcacccttcctgtgctaagatttaaaaaaaaatgaggctggattgcgggaagctctaaaatgaagcaaaaggagtaagatttttaaagacagaaagccacaggagcccccacgtagcgcacttttatttgtattttttcagatttttttttgtttcgtggtggtgggggaggtgattgggtggctgactggctgcgggaagctacttcctttccttttggagatgattgtgctattattgtttgccttgctctggatggtggaaggagtcttttcccagcttcactacacggtacaggaggagcaggaacatggcactttcgtggggaatatcgctgaagatctgggtctggacattacaaaactttcggctcgcgggtttcagacggtgcccaactcaaggaccccttacttagacctcaacctggagacaggggtgctgtacgtgaacgagaaaatagaccgcgaacaaatctgcaaacagagcccctcctgtgtcctgcacctggaggtctttctggagaaccccctggagctgttccaggtggagatcgaggtgctggacattaatgacaaccccccctctttcccggagccagacctgacggtggaaatctctgagagcgccacgccaggcactcgcttccccttggagagcgcattcgacccagacgtgggcaccaactccttgcgcgactacgagatcacccccaacagctacttctccctggacgtgcagacccagggggatggcaaccgattcgctgagctggtgctggagaagccactggaccgagagcagcaagcggtgcaccgctacgtgctgaccgcggtggacggaggaggtgggggaggagtaggagaaggagggggaggtggcgggggagcaggcctgcccccccagcagcagcgcaccggcacggccctactcaccatccgagtgctggactccaatgacaatgtgcccgctttcgaccaacccgtctacactgtgtccctaccagagaactctcccccaggcactctcgtgatccagctcaacgccaccgacccggacgagggccagaacggtgaggtcgtgtactccttcagcagccacatttcgccccgggcgcgggagcttttcggactctcgccgcgcactggcagactggaggtaagcggcgagttggactatgaagagagcccagtgtaccaagtgtacgtgcaagccaaggacctgggccccaacgccgtgcctgcgcactgcaaggtgctagtgcgagtactggatgctaatgacaacgcgccagagatcagcttcagcaccgtgaaggaagcggtgagtgagggcgcggcgcccggcactgtggtggcccttttcagcgtgactgaccgcgactcagaggagaatgggcaggtgcagtgcgagctactgggagacgtgcctttccgcctcaagtcttcctttaagaattactacaccatcgttaccgaagcccccctggaccgagaggcgggggactcctacaccctgactgtagtggctcgggaccggggcgagcctgcgctctccaccagtaagtcgatccaggtacaagtgtcggatgtgaacgacaacgcgccgcgtttcagccagccggtctacgacgtgtatgtgactgaaaacaacgtgcctggcgcctacatctacgcggtgagcgccaccgaccgggatgagggcgccaacgcccagcttgcctactctatcctcgagtgccagatccagggcatgagcgtcttcacctacgtttctatcaactctgagaacggctacttgtacgccctgcgctccttcgactatgagcagctgaaggacttcagttttcaggtggaagcccgggacgctggcagcccccaggcgctggctggtaacgccactgtcaacatcctcatagtggatcaaaatgacaacgcccctgccatcgtggcgcctctaccagggcgcaacgggactccagcgcgtgaggtgctgccccgctcggcggagccgggttacctgctcacccgcgtggccgccgtggacgcggacgacggcgagaacgcccggctcacttacagcatcgtgcgtggcaacgaaatgaacctctttcgcatggactggcgcaccggggagctgcgcacagcacgccgagtcccggccaagcgcgacccccagcggccttatgagctggtgatcgaggtgcgcgaccatgggcagccgcccctttcctccaccgccaccctggtggttcagctggtggatggcgccgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcctctgctgctgctgctgcggtggcggaggttcgacctgctgtggccgccaagcccgggcgcgcaagaagaaactcagcaagtcagacatcatgctggtgcagagctccaatgtacccagtaacccggcccaggtgccgatagaggagtccgggggctttggctcccaccaccacaaccagaattactgctatcaggtatgcctgacccctgagtccgccaagaccgacctgatgtttcttaagccctgcagcccttcgcggagtacggacactgagcacaacccctgcggggccatcgtcaccggttacaccgaccagcagcctgatatcatctccaacggaagcattttgtccaacgagactaaacaccagcgagcagagctcagctatctagttgacagacctcgccgagttaacagttctgcattccaggaagccgacatagtaagctctaaggacagtggtcatggagacagtgaacagggagatagtgatcatgatgccaccaaccgtgcccagtcagctggtatggatctcttctccaattgcactgaggaatgtaaagctctgggccactcagatcggtgctggatgccttcttttgtcccttctgatggacgccaggctgctgattatcgcagcaatctgcatgttcctggcatggactctgttccagacactgaggtgtttgaaactccagaagcccagcctggggcagagcggtccttttccacctttggcaaagagaaggcccttcacagcactctggagaggaaggagctggatggactgctgactaatacgcgagcgccttacaaaccaccatatttgagaaaaaaacagagatgc

SEQ ID NO: 24806 - DNA, 3933 bp, Homo sapiens
atggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctaccttcatcccaaggagcccaacagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaa

SEQ ID NO: 24807 - DNA, 4044 bp, Homo sapiens
atggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagcggaaatctgaagggaaagtggcaggaaagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctaccttcatcccaaggagcccaacagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaa

SEQ ID NO: 24808 - DNA, 3990 bp, Homo sapiens
atggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaa

SEQ ID NO: 24809 - DNA, 4603 bp, Homo sapiens
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccggtaggtatccaagtttctaacacaactttctaactatttttttattattattttcagttgatgtagaactttacaaaatctattgacttcaaagagggatcaaaacaatcatattctacagatgtacccaatagatatatggattcaattaagtttggtagaagatgagaacaaaataactactgatttaggaaaattggatgcagaataataattatagtaggggcaattttgtctgtagatggcagtatgacaattcttgctagagaatatattgaaaaaaacttcaacacaaagggttgtagcactgtcctcagtaccattgtgtgcatgaggatcagaatagtctgggctagatacatcacattaaagcttttcagaatctgataaatagctctaaatactaatgatattgagaagcctagcttcacttgggaaaatctgtggctgttcacagaaattcagcaccaagttattccccccatactctaccaggccttcaggtcctcataaagaaaagtgtcgttttcagattaggaactcaaaattattttggtgcatcaaatctacagtcacacaatataacaagaatgggattagaaaaatgaaagcctactcattctcatctttaagccagagaatgaaatatatatgaggtctctggatagctatttaaatatttgcatatttatgcaaggtattttgagcccttcagaagacattct

SEQ ID NO: 24810 - DNA, 4061 bp, Homo sapiens
atggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataa

SEQ ID NO: 24811 - DNA, 9176 bp, Homo sapiens
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagcggaaatctgaagggaaagtggcaggaaagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgcactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataacgttaaaaggtatacgtactctagcctttttttgggctttctttttgatttttgtttgttgttttcagtttttttgttgttgttagtgagtctcccttcaaaatacgcagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcctctttttactttaatagtttagtgtaaagtacatcagaaataaagctgtatctgccattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccatatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaacaagaaataccaataacacacacagaacaaaaaccatcaaaatctcatatatgaaataaaatatattcttctaagcaaagaaacagtactattcatagaaaacattagttttcttctgttgtctgttatttccttcttgtatcctcttaactggccattatcttgtatgtgcacattttataaatgtacagaaacatcaccaacttaattttcttccatagcaaaactgagaaaataccttgtttcagtataacactaaaccaagagacaattgatgtttaatgggggcggttggggtgggggggggagtcaatatctcctattgattaacttagacatagattttgtaatgtataacttgatatttaatttatgattaaactgtgtgtaaattttgtaacataaactgtggtaattgcataatttcattggtgaggatttccactgaatattgagaaagtttcttttcatgtgcccagcaggttaagtagcgttttcagaatatacattattcccatccattgtaaagttccttaagtcatatttgactgggcgtgcagaataacttcttaacttttaactatcagagtttgattaataaaattaattaatgttttttctccttcgtgttgttaatgttccaagggatttggagcatactggttttccaggtgcatgtgaatcccgaaggactgatgatatttgaatgtttattaaattattatcatacaaatgtgttgatattgtggctattgttgatgttgaaaattttaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaaactttagttttctgatgatctacacacacacacacacacacacgtgcacacacacacacatttaaatgatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgacgttttgacacctttcctatagatgatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttccttctctttctaagcgtccactaggtctggccttggaaacctgttacttctagggcttcagatctgatgatatctttttcatcacattacaagttatttctctgactgaatagacagtggtataggttgacacagcacacaagtggctattgtgatgtatgatgtatgtagtcctacaactgcaaaacgtcttactgaaccaacaatcaaaaaatggttctgttttaaaaaggattttgtttgatttgaaattaaaacttcaagctgaatgacttatatgagaataatacgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaatccttttcaatcctgagaaaattaaaggcgttttactcacatggctatttcaacattagttttttttgtttgtttctttttcatggtattactgaaggtgtgtatactccctaatacacatttatgaaaatctacttgtttaggcttttatttatactcttctgatttatattttttattataattattatttcttatctttcttcttttatattttttggaaaccaaatttatagttagtttaggtaaactttttattatgaccattagaaactattttgaatgcttccaactggctcaattggccgggaaaacatgggagcaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgattgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaaccatgctttggaagtaagaaggttgactattgtatggccaaggatggcagtatgtaatccagaagcaaacttgtattaattgttctatttcaggttctgtattgcatgttttcttattaatatatattaataaaagttatgagaaat

SEQ ID NO: 24812 - DNA, 9149 bp, Homo sapiens
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgcactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataacgttaaaaggtatacgtactctagcctttttttgggctttctttttgatttttgtttgttgttttcagtttttttgttgttgttagtgagtctcccttcaaaatacgcagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcctctttttactttaatagtttagtgtaaagtacatcagaaataaagctgtatctgccattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccatatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaacaagaaataccaataacacacacagaacaaaaaccatcaaaatctcatatatgaaataaaatatattcttctaagcaaagaaacagtactattcatagaaaacattagttttcttctgttgtctgttatttccttcttgtatcctcttaactggccattatcttgtatgtgcacattttataaatgtacagaaacatcaccaacttaattttcttccatagcaaaactgagaaaataccttgtttcagtataacactaaaccaagagacaattgatgtttaatgggggcggttggggtgggggggggagtcaatatctcctattgattaacttagacatagattttgtaatgtataacttgatatttaatttatgattaaactgtgtgtaaattttgtaacataaactgtggtaattgcataatttcattggtgaggatttccactgaatattgagaaagtttcttttcatgtgcccagcaggttaagtagcgttttcagaatatacattattcccatccattgtaaagttccttaagtcatatttgactgggcgtgcagaataacttcttaacttttaactatcagagtttgattaataaaattaattaatgttttttctccttcgtgttgttaatgttccaagggatttggagcatactggttttccaggtgcatgtgaatcccgaaggactgatgatatttgaatgtttattaaattattatcatacaaatgtgttgatattgtggctattgttgatgttgaaaattttaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaaactttagttttctgatgatctacacacacacacacacacacacgtgcacacacacacacatttaaatgatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgacgttttgacacctttcctatagatgatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttccttctctttctaagcgtccactaggtctggccttggaaacctgttacttctagggcttcagatctgatgatatctttttcatcacattacaagttatttctctgactgaatagacagtggtataggttgacacagcacacaagtggctattgtgatgtatgatgtatgtagtcctacaactgcaaaacgtcttactgaaccaacaatcaaaaaatggttctgttttaaaaaggattttgtttgatttgaaattaaaacttcaagctgaatgacttatatgagaataatacgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaatccttttcaatcctgagaaaattaaaggcgttttactcacatggctatttcaacattagttttttttgtttgtttctttttcatggtattactgaaggtgtgtatactccctaatacacatttatgaaaatctacttgtttaggcttttatttatactcttctgatttatattttttattataattattatttcttatctttcttcttttatattttttggaaaccaaatttatagttagtttaggtaaactttttattatgaccattagaaactattttgaatgcttccaactggctcaattggccgggaaaacatgggagcaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgattgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaaccatgctttggaagtaagaaggttgactattgtatggccaaggatggcagtatgtaatccagaagcaaacttgtattaattgttctatttcaggttctgtattgcatgttttcttattaatatatattaataaaagttatgagaaataaa

SEQ ID NO: 24813 - DNA, 4767 bp, Homo sapiens
tcacttctctccccacgccttcccctggttcaccccccttccttcccctttctccccctcggttaagtccctccccctcgccattcaaaagggctggctcggcactggctccttgcagtcggcgaactgtcggggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggaaaatcctgttgcgaataagaaggattccacagatcacataccggagaggttttgcctcagctgctctcaactttgtaatcttgtgaagaagctgacaagcttggctgattgcagagcactatgaggactgaacgacagtgggttttaattcagatatttcaagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgactgattccaggacatcaactattgaaatctgcagtgagatataactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcacaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatctccaggagtttggaagtgagctgaactagccaaactactctctgaaaggtatccagggcaagagacatttttaagaccccaaacaaacaaaaaacaaaaccaaaacactctggttcagtgttttgaaaatattcactaacataatattgctgagaaaatcatttttattacccaccactctgcttaaaagttgagtgggccgggcgcggtggctcacgcctgtaatcccagcactttgggaggccgaggcgggtggatcacgaggtcaggagattgagaccatcctggctaacacggtgaaaccccatctccactaaaaatacaaaaaattagcctggcgtggtggcgggcgcctgtagtcccagctactcgggaggctgaggcaggagaatagcgtgaacccgggaggcggagcttgcagtgagccgagatggcgccactgcactccagcctgggtgacagagcaagactctgtctcaaaaagaaaaaaatgttcaatgatagaaaataattttactaggtttttatgttgattgtactcatgctgttccactccttttaattattaaaaagttatttttggctgggtgtggtggctcacacctgtaatcccagcactttgggaggccgaggtgggtggatcacctgaggtcaggagttcaagaccagtctggccaacat

SEQ ID NO: 24814 - DNA, 4020 bp, Homo sapiens
atggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagcggaaatctgaagggaaagtggcaggaaagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaa

SEQ ID NO: 24815 - DNA, 4019 bp, Homo sapiens
atggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagcggaaatctgaagggaaagtggcaggaaagactgtgcttacttcctcttccccttctgccatgaccctttcatacctggactaaagaaagagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacag

SEQ ID NO: 24816 - DNA, 4023 bp, Homo sapiens
atgtttagggttggcttcttaataatttcttcttcctcttctctctctcctcttcttttggtcagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgtcccagcggcgtgtcacatttcacctgccagaaggctctcaggaaagcagcagtgatggtggactgggagaccatgatgcaggcagccttaccagcacatcccatggcctgccccttggctatcctcaggaggagtactttgatcgtgctacacccagcaatcgcactgaaggggatggcaactccgatcctgaatctaattttatcagtgggatgagggagaaaataactgttcaaccaactgtggaagaggcctctgacaactgcactcaagaatgtctcatctatggccattctgatgcctgctggatgccggcatctctggatcattccagctcttcacaagcacaggcctctgctctatgccacagcccaccactgtcacaggcctctactcagcaccacagcccaccagtgacacagaccattgttctctgccacagccctccagtgacacagaccatcgcattgtgccacagcccaccaccgatacaggtgtctgctctccaccacagtcctcctctagtgcagggtactgcacttcaccacagcccaccatcagcacaggcctcagccctctgctacagccctcctttagcacaggctgctgcaatcagccacagctcttctctgccacaggttattgccctccatcgtagtcaggcccaatcatcagtcagtttgcagcaaggttgggtgcaaggtgctaatggactatgctctgttgatcagggagtgcaaggtagtgcaacatctcagttttacaccatgtctgaaagacttcatcccagtgatgattcaattaaagtcattcctttgacaaccttcgctccacgccaacaggccagaccgtccagaggtgattcccccattatggaaacacatcccttgtaa

SEQ ID NO: 24817 - DNA, 4710 bp, Homo sapiens
cccctttctccccctctgttaagtccctccccctcgccattcaaaagggctggctcggcactggctccttgcagtcggcgaactgtctgggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggaaaatcctgttgtgaataagaaggattccacagatcacataccagagcggttttgcctcagctgctctcaactttgtaatcttgtgaagaagctgacaagcttggctgattgcagtgcactatgaggactgaatgacagtgggttttaattcagatatttcaagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgactgattccaggacatgaactattgaaatctgcagtgagatgtaactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcgcaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatctccaggagtttggaagtgagctgaactagccaaactactctctgaaaggtatccagggcaagagacatttttaagaccccaaacaaacaaaaaacaaaaccaaaacactctggttcagtgttttgaaaatattgactaacataatattgctgagaaaatcatttttattacccaccactctgcttaaaagttgagtgggccgggcgcggtggctcacgcctgtaattccagcactttgggaggccgaggcgggtggatcacgaggtcaggatattgagaccatcctggctaacatggtgaaaccccatctccactaaaaatacaaaaaattagctgggcgtggtggcgggcgcctgtagtcccagctactcgggaggctgaggcaggagaatggcgtgaacccgggaggcggagcttgcagtgagccgagatggcgccactgcactccagcctgggtgacagagcaagactctgtctcaaaaagaaaaaaatgttcagtgatagaaaataattttactaggtttttatgttgattgtactcatgctgttccactccttttaattattaaaaagttatttttggctgggtgtggtggctcatacctgtaatcccagcactttgggaggccgaggcgggtggatcacctgaggtcaggagttcaagaccagtctggccaacat

SEQ ID NO: 24818 - DNA, 4220 bp, Homo sapiens
ggtggtccagtacctccaaagatatggaatacactcctgaaatatcctgaaaccttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcgttagtcacatcaacccctctcctctcccaaacttctcttcttcaaatcaaactttattagtccctcctttataatgattccttgcctccttttatccagatcaattttttttcactttgatgcccagagctgaagaaatggactattgtataaattattcattgccaagagaataattgcattttaaacccatgttataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgactgattccaggacatgaactattgaaatctgcagtgagatgtaactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcgcaataacagagtactctcatgctgtttctctgtttgctctgaatcaacagccatgatgtaatataaggctgtcttggtgtatacacttatggttaat

SEQ ID NO: 24819 - DNA, 8240 bp, Homo sapiens
tgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgtcccagcggcgtgtcacatttcacctgccagaaggctctcaggaaagcagcagtgatggtggactgggagaccatgatgcaggcagccttaccagcacatcccatggcctgccccttggctatcctcaggaggagtactttgatcgtgctacacccagcaatcgcactgaaggggatggcaactccgatcctgaatctactttcatacctggactaaagaaagaaataactgttcaaccaactgtggaagaggcctctgacaactgcactcaagaatgtctcatctatggccattctgatgcctgctggatgccggcatctctggatcattccagctcttcacaagcacaggcctctgctctatgccacagcccaccactgtcacaggcctctactcagcaccacagcccaccagtgacacagaccattgttctctgccacagccctccagtgacacagaccatcgcattgtgccacagcccaccaccgatacaggtgtctgctctccaccacagtcctcctctagtgcagggtactgcacttcaccacagcccaccatcagcacaggcctcagccctctgctacagccctcctttagcacaggctgctgcaatcagccacagctcttctctgccacaggttattgccctccatcgtagtcaggcccaatcatcagtcagtttgcagcaaggttgggtgcaaggtgctaatggactatgctctgttgatcagggagtgcaaggtagtgcaacatctcagttttacaccatgtctgaaagacttcatcccagtgatgattcaattaaagtcattcctttgacaaccttcgctccacgccaacaggccagaccgtccagaggtgattcccccattatggaaacacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgtactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataatgttaaaaggtatacgtactctagccttttttggggctttctttttgatttttgtttgtggttttcagtttttttgttgttgttagtgagtctcccttcaaaatacacagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcccctttttactttaatagtttagtgtaaagtacatcagaaataaaactgtatctgacattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccacatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaagaagaaataccaataacacacacagaacaaaaaccatcaaaatctcatatatgaaataaaatatattcttctaagcaaagaaacagtactattcatagaaaacattagttttctcctgttgtctgttatttccttcttttatcctcttaactggccattatcttgtatgtgcacattttataaatgtacagaaacatcaccaacttgattttcttccatagcaaaactgagaaaataccttgtttcagtataacactaaaccaagagacaattgatgtttaatgggggcggttggggttgggggggagtcaatatctcctattgattaacttagacatagattttgtaatgtataacttgatatttaatttatgattaaactgtaattttgtaacataaactgtggtaattgcataatttcattggtgaggatttcctttgaatattgagaaagtttcttttcatgtgcccagcaggttaagtagcgttttcagaatatacattattcccatccattgtaaagttccttaagtcatatttgactgggcgtgcagaataacttcttaactattaactatcagagtttgattaataaaattaattaattttttttctccttcgtgttgttaatgttccaagggatttggagcatactggttttccaggtgcatgtgaatcccgaaggactgatgatatttgaatgtttattaaattattatcacacaaatgtgttgatattgtggctattgttgatgttgaaaattgtaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaacctttagttttctgatgatctacacacacacatacacacacacacacacacacgtgcacacacacacatttaaaggatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgaagttttgacacctttcctatagatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttctcttcctaagcgtccactaggtctggccttggaaatctgttacttctacggcttcagatctgatgatatctttttcatcacattacaagttatttctttgactgaatagacagtggtataggttgacacagcacacaagtggctattgtgatgtatgatgtatgtagtcccacaactgcaaaacgtcttactgaagcaacaatcgaaaaatggttctgttttaaaaaggattttgtttgatttgaaattaaaacttcaaactgaatgacttatatgagaataatatgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaaatccttttcaatcctgagaaaattaaaggtgttttactcacatggatatttcaacattagttttttttgtttgtttctttttcatggtattactgaaggtgtgtatactccctaatacacatttatgaaaatctacttgtttagacttttatttatactcttctgatttatattttttattataattattatttcttatcttcttttatattttttggaaaccaaatttatagttagtttaggtaaactttttattatgaccattagaaactattttgaatgtttccaactggctcaattggctgggaaaacatgggaacaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgactgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaagcatgctttggaagtaagaaggttgactattgtatggccaaggatggcagtatgtaatccagaagcaaacttgtattaattgttctatttcaggttctgtattgcatgttttcttattaatatatattaataaaagttatgagaaataaa

SEQ ID NO: 24820 - DNA, 6562 bp, Homo sapiens
gggaagcgggaggagagccacacggtcaagttgcacaggttcttgcagcttctggaatcaagaccatgggcaccctcataagtcagtgtgggcagggactgccccagggccaatccaagatccagaggtagccatagggtgtgacaagttgtgcagattacaacactcaccccttgcaataacgtcactgcctgtgactcggggccaggcccaggccaaagcccttcctacatcatttcgtttaatcctcacagtttcctgctgaaagggctactattcttactcccatccccactctacagatgaggtaatggaggcccaggaaagttaagtgacttgtcccagatgacaccgctggtaagttgcaaagtcagaatttgaactcaggcagtttacctctgatggctgctctgttaatcacagctgctttccagtgagacaaaaacgggtgatcagggcagagtcaagacagagaggtaaacaagattgggaaaaagacaggaatgagaggggaacaatgggggaaaagataggaacaaagagagttggggaaggggagagaaacaggaaacatgacttgcccgggaggggcatcagtccacgtgcaagcaggtggaggctcaagttttctgctcacttggtgatgcagaggctccctttccctcagcagccgccttgctgcgtggacagcagcttcccatctggcctgtccccggagccccggcctcatcctcctcagcggcaggccacttagcttcacaggaaatgctctttctctaattggcattgaaactcacagccctcccttttcctgtaggtggggtttccataggaaaaagctgcttctctgtttccccagcctagcaactgtttggcagtcagagtcccacatcctgctcaactgggtcaggtccctcttagaccagctcttgtccatcatttgctgaagtggaccaactagttccccagtagggggtctcccctggcaattcttgatcggcgtttggacatctcagatcgcttccaatgaagatggccttgccttggggtcctgcttgtttcataatcatctaactatgggacaaggttgtgccggcagctctgggggaaggagcacggggctgatcaagccatccaggaaacactggaggacttgtccagccttgaaagaactctagtggtttctgaatctagcccacttggcggtaagcatgatgcaacttctgcaacttctgctggggcttttggggccaggtggctacttatttcttttaggggattgtcaggaggtgaccactctcacggtgaaataccaagtgtcagaggaagtgccatctggtacagtgatcgggaagctgtcccaggaactgggccgggaggagaggcggaggcaagctggggctgccttccaggtgttgcagctgcctcaggcgctccccattcaggtggactctgaggaaggcttgctcagcacaggcaggcggctggatcgagagcagctgtgccgacagtgggatccctgcctggtttcctttgatgtgcttgccacaggggatttggctctgatccatgtggagatccaagtgctggacatcaatgaccaccagccacggtttcccaaaggcgagcaggagctggaaatctctgagagcgcctctctgcgaacccggatccccctggacagagctcttgacccagacacaggccctaacaccctgcacacctacactctgtctcccagtgagcactttgccttggatgtcattgtgggccctgatgagaccaaacatgcagaactcatagtggtgaaggagctggacagggaaatccattcattttttgatctggtgttaactgcctatgacaatgggaacccccccaagtcaggtaccagcttggtcaaggtcaacgtcttggactccaatgacaatagccctgcgtttgctgagagttcactggcactggaaatccaagaagatgctgcacctggtacgcttctcataaaactgaccgccacagaccctgaccaaggccccaatggggaggtggagttcttcctcagtaagcacatgcctccagaggtgctggacaccttcagtattgatgccaagacaggccaggtcattctgcgtcgacctctagactatgaaaagaaccctgcctacgaggtggatgttcaggcaagggacctgggtcccaatcctatcccagcccattgcaaagttctcatcaaggttctggatgtcaatgacaacatcccaagcatccacgtcacatgggcctcccagccatcactggtgtcagaagctcttcccaaggacagttttattgctcttgtcatggcagatgacttggattcaggacacaatggtttggtccactgctggctgagccaagagctgggccacttcaggctgaaaagaactaatggcaacacatacatgttgctaaccaatgccacactggacagagagcagtggcccaaatataccctcactctgttagcccaagaccaaggactccagcccttatcagccaagaaacagctcagcattcagatcagtgacatcaacgacaatgcacctgtgtttgagaaaagcaggtatgaagtctccacgcgggaaaacaacttaccctctcttcacctcattaccatcaaggctcatgatgcagacttgggcattaatggaaaagtctcataccgcatccaggactccccagttgctcacttagtagctattgactccaacacaggagaggtcactgctcagaggtcactgaactatgaagagatggccggctttgagttccaggtgatcgcagaggacagcgggcaacccatgcttgcatccagtgtctctgtgtgggtcagcctcttggatgccaatgataatgccccagaggtggtccagcctgtgctcagcgatggaaaagccagcctctccgtgcttgtgaatgcctccacaggccacctgctggtgcccatcgagactcccaatggcttgggcccagcgggcactgacacacctccactggccactcacagctcccggccattccttttgacaaccattgtggcaagagatgcagactcgggggcaaatggagagcccctctacagcatccgcagtggaaatgaagcccacctcttcatcctcaaccctcatacggggcagctgttcgtcaatgtcaccaatgccagcagcctcattgggagtgagtgggagctggagatagtagtagaggaccagggaagcccccccttacagacccgagccctgttgagggtcatgtttgtcaccagtgtggaccacctgagggactcagcccgcaagcctggggccttgagcatgtcgatgctgacggtgatctgcctggctgtactgttgggcatcttcgggttgatcctggctttgttcatgtccatctgccggacagaaaagaaggacaacagggcctacaactgtcgggaggccgagtccacctaccgccagcagcccaagaggccccagaaacacattcagaaggcagacatccacctcgtgcctgtgctcaggggtcaggcaggtgagccttgtgaagtcgggcagtcccacaaagatgtggacaaggaggcgatgatggaagcaggctgggacccctgcctgcaggcccccttccacctcaccccgaccctgtacaggacgctgcgtaatcaaggcaaccagggagcaccggcggagagccgagaggtgctgcaagacacggtcaacctccttttcaaccatcccaggcagaggaatgcctcccgggagaacctgaaccttcccgagccccagcctgccacaggccagccacgttccaggcctctgaaggttgcaggcagccccacagggaggctggctggagaccagggcagtgaggaagccccacagaggccaccagcctcctctgcaaccctgagacggcagcgacatctcaatggcaaagtgtcccctgagaaagaatcagggccccgtcagatcctgcggagcctggtccggctgtctgtggctgccttcgccgagcggaaccccgtggaggagctcactgtggattctcctcctgttcagcaaatctcccagctgctgtccttgctgcatcagggccaattccagcccaaaccaaaccaccgaggaaataagtacttggccaagccaggaggcagcaggagtgcaatcccagacacagatggcccaagtgcaagggctggaggccagacagacccagaacaggaggaagggcctttggatcctgaagaggacctctctgtgaagcaactgctagaagaagagctgtcaagtctgctggaccccagcacaggtctggccctggaccggctgagcgcccctgacccggcctggatggcgagactctctttgcccctcaccaccaactaccgtgacaatgtgatctccccggatgctgcagccacggaggagccaaggaccttccagacgttcggcaaggcagaggcaccagagctgagcccaacaggcacgaggctggccagcacctttgtctcggagatgagctcactgctggagatgctgctggaacagcgctccagcatgcccgtggaggccgcctccgaggcgctgcggcggctctcggtctgcgggaggaccctcagtttagacttggccaccagtgcagcctcaggcatgaaagtgcaaggggacccaggtggaaagacggggactgagggcaagagcagaggcagcagcagcagcagcaggtgcctgtgaacatacctcagacgcctctggatccaagaaccaggggcctgaggatctgtggacaagagctggtttctaaaatcttgtaactcactagctagcggcggcctgagaactttagggtgactgatgctacccccacagaggaggcaagagccccaggactaacagctgactgaccaaagcagccccttgtaagcagctctgagtcttttggaggacagggacggtttgtggctgagataagtgtttcctggcaaaacatatgtggagcacaaagggtcagtcctctggcagaacagatgccacggagtatcacaggcaggaaagggtggccttcttgggtagcaggagtcagggggctgtaccctgggggtgccaggaaatgctctctgacctatcaataaaggaaaagcagtgattcattctcctgtttgcacctgtcaagagggagaagggaagagtaatagagtggggtttatttgtcatccaatccctggcaagaccgtcacactgggcctggacaggagtggggcaccttggtacacagtaacaggtacacaaatagcagacatgtgtgctcttacccctgttcccctatcactatgttaccaactaatctgcttctcagctgcaaaattagagctaagaaagcacaactatttataaagcatttacatgagccaggcaccaggctttacaataggatttaatttgattttccaacaatcctgggagggaggtattattaaccccatttcacagacacggatatggggcttggagaggtcaagtggctttcccaagatcaagcagggagtagagccagagccaggatttggacccaggctgggccaacaccaaaacccatgccttcaaccttgacaccagcctgccaaccaaagacaggagaagggaaggccctggaggtgagctgttggcagcagtgaacttgctcgagctccctcgggaaacactgttgaaaggaacatttccaaagccatccaggcccgcacctctctacattcccaagcacaaggcaaaaggaacttggatctgaactgatgcagacccgttctttcccaacaagtagctcttcaagtgcggatgtcatctttcccaaccccatttgcgggtaaaccttcctctgtcattgcaggttcaggcttgtgaatcccagaggacgctgtgtgaactgggtctatgaaatcggcactgacagcagccagccttccaggggatgggggagggaagaaacagcagatattttcccaaggttcagctttataattttcttggaaatttccgagcagccaatcagctagcttctaaatagtgtgggtctctcctggacactgcaggcaaaagttcctctatctgctcctctttttgtcctttcttggagctcagtgctcatgttcactgttcaagaaatgggccaatcatactcccaactagggataatgtgcatcatacatacttggaatacagtgtggtatcattattccattttacagatgaagaaaatgaggctccccaaagttatgagtttcaggggcagagtttctcctcacctcactctaggccagagtgatctccttacagaatctgtgattttcaggctggatcacagaactgttgggttctgtgggccagtgagagaaactgggggatatcaagcaggcaggcagggtctccagcctgaccagccaggtgcctgctacaaagcaacacttgatgaatagctgttgaatggatgtatgaatgaataaatgtgtcaataaatgcttcagaggcccctttta

SEQ ID NO: 24821 - DNA, 572 bp, Homo sapiens
acagtttcctgctgaaagggctactattcttactcccatccccactctacagatgaggtaatggaggcccaggaaagttaagtgacttgtcccagatgacaccgctggtggggtttccataggaaaaagctgcttctctgtttccccagcctagcaactgtttggcagtcagagtcccacatcctgctcaactgggtcaggtccctcttagaccagctcttgtccatcatttgctgaagtggaccaactagttccccagtagggggtctcccctggcaattcttgatcggcgtttggacatctcagatcgcttccaatgaagatggccttgccttggggtcctgcttgtttcataatcatctaactatgggacaaggttgtgccggcagctctgggggaaggagcacggggctgatcaagccatccaggaaacactggaggacttgtccagccttgaaagaactctagtggtttctgaatctagcccacttggcggtaagcatgatgcaacttctgcaacttctgctggggcttttggggccaggtggctacttatttcttttaggggattg

SEQ ID NO: 24822 - DNA, 7523 bp, Homo sapiens
tcctgcccccaccttacaggtctgggatgtacctttccatctgttgctgctttcttctatgggcccctgccctcactctcaagaacctcaactactccgtgccggaggagcaaggggccggcacggtgatcgggaacatcggcagggatgctcgactgcagcctgggcttccgcctgcagagcgcggcggcggagggcgcagcaagtcgggtagctaccgggtgctggagaactccgcaccgcacctgctggacgtggacgcagacagcgggctcctctacaccaagcagcgcatcgaccgcgagtccctgtgccgccacaatgccaagtgccagctgtccctcgaggtgttcgccaacgacaaggagatctgcatgatcaaggtagagatccaggacatcaacgacaacgcgccctccttctcctcggaccagatcgaaatggacatctcggagaacgctgctccgggcacccgcttccccctcaccagcgcacatgaccccgacgccggcgagaatgggctccgcacctacctgctcacgcgcgacgatcacggcctctttggactggacgttaagtcccgcggcgacggcaccaagttcccagaactggtcatccagaaggctctggaccgcgagcaacagaatcaccatacgctcgtgctgactgccctggacggtggcgagcctccacgttccgccaccgtacagatcaacgtgaaggtgattgactccaacgacaacagcccggtcttcgaggcgccatcctacttggtggaactgcccgagaacgctccgctgggtacagtggtcatcgatctgaacgccaccgacgccgatgaaggtcccaatggtgaagtgctctactctttcagcagctacgtgcctgaccgcgtgcgggagctcttctccatcgaccccaagaccggcctaatccgtgtgaagggcaatctggactatgaggaaaacgggatgctggagattgacgtgcaggcccgagacctggggcctaaccctatcccagcccactgcaaagtcacggtcaagctcatcgaccgcaacgacaatgcgccgtccatcggtttcgtctccgtgcgccagggggcgctgagcgaggccgcccctcccggcaccgtcatcgccctggtgcgggtcactgaccgggactctggcaagaacggacagctgcagtgtcgggtcctaggcggaggagggacgggcggcggcgggggcctgggcgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgcacgagaacaacatcccgggagagtacctgggctctgtgctcgcccaggatcccgacctgggccagaacggcaccgtatcctactctatcctgccctcgcacatcggcgacgtgtctatctacacctatgtgtctgtgaatcccacgaacggggccatctacgccctgcgctcctttaacttcgagcagaccaaggcttttgagttcaaggtgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagccacccgcagctgggtgggggcaagggcaagaagaagaagatcaacaaaaatgatatcatgctggtgcagagcgaagtggaggagaggaacgccatgaacgtcatgaacgtggtgagcagcccctccctggccacctcccccatgtacttcgactaccagacccgcctgcccctcagctcgccccggtcggaggtgatgtatctcaaaccggcctccaacaacctgactgtccctcaggggcacgcgggctgccacaccagcttcaccggacaagggactaatgcaagcgagacccctgccactcggatgtccataattcagacagacaattttcccgcagagcccaattacatgggcagcaggcagcagtttgttcaaagtagctccacgtttaaggacccagaaagagccagcctgagagacagtgggcacggggacagtgatcaggctgacagtgaccaagacactaacaaaggctcctgctgtgacatgtctgttagggaggcactcaagatgaaaactacttcaactaaaagccaaccacttgaacaagaaccagaagagtgtgttaattgcacagatgaatgccgagtgcttggtcattctgacaggtgctggatgccacagttccctgcagccaatcaggctgaaaatgcagattaccgcacaaatctctttgtacctacagttgaagctaatgttgagactgagacttacgaaactgtgaatcccactgggaaaaagactttttgtacatttggaaaagacaagcgagagcacactattctcattgccaacgttaaaccttatttaaaagccaaacgtgccctgagccctctcctccaagaggtcccctcagcatcaagcagcccaaccaaggcgtgcatcgagccttgcacctcaacaaaaggctccctggatggctgtgaagcaaaaccaggagccctggctgaagcaagcagtcagtacttgcccactgacagtcaatatctgtcacctagtaagcaaccaagagaccctcccttcatggcttccgatcagatggcaagggtctttgcagatgtgcattccagagccagccgggattccagtgagatgggtgctgttcttgagcagcttgaccaccccaacagggatctgggcagagagtctgtggatgcagaggaagttgtgagagaaattgataagcttttgcaagactgccggggaaacgaccctgtggctgtgagaaagtgaaaaaagaaaaaaaaaaaggcattggcattttcttgtctcttctgttgatttaaaaatgatccctcctggtgataacccattttacagggatgaagaaagaccaatgctgctttaaggcttttagtgaacatctgaagtgcccacaagtatgttctttccactgctgatttctttttcagagataacaatggtttcgttttgaccaaacttgtattaggacagaattaatgatgcttaaagagaaaagaaaaaaagagagaagaaaaaggagagatgaaaaaggaggatgaggagaagaattaccttttgacaatctgttaggaaggtatgcagtgtgagaactgaagtatttctgatcactctcagactgtcctccgtgatttatgctgacttaactgtttacctataaaccccatacaaagcagggtcataatttgtgatctgtggtggatttctagcagtcatcacaggcttctactgaaagtcctgaaaagaccttgcagtagtccaagctacaccaaacattaacacatatttgtggtaaacatttctgtataaagttacctgacacacatataaacacaaggaacattccatatcattagtcgaaaacaaaaacaaaaaaaaaacctttggtcatttgtaagacatctcatgtcatataaaagttaaatgtaaaaagatacagtccattttgtcctgcacacacgtagactaattcacgtcattaaagaagaagaaaacttaaagatttaaaatgcctatttagcattttagtgtccaacaaagatttaaacaatgatgaatatgttttaaatttgacatagaaaagttctaaaaaatagttaccattgagtggtaagattcagagaaaattaacttgattaatatgttttattcatttgtggacactaaaatagctcaggaaagtgaaaatgtcttagacatacgcaagtcacatgaccatttaaatgtgcaaatgtaagaagattcaatgtgtttacatcaaatgacatattttattgatttattgcagattcagtgcatatgagccaaattgttgagtgtgtaagagctatattgtgtattttattaaattaatatatagttgtgttgcaaaaatatttgggcttatattgtaaatggcaagtgttgccttggtagctgtcgaactctatgagttttgttttttcctgcttccttttccccatggagtgtgggaagcagtgcctcagagcaaagtctcttgtttaatgtatagtctaccaagtactacagtacataatctgttcaaaatgtgtttgagtgagctgatggagctaactgaaaggtcaaaaattacatccatcagtcatggttatgtgcaagtccttgtagaagcttttattaaagtcatgctaaatcacaagaattgacatttgtaccaatatctgaaacttcttcatgttttttcaataacatacagcttctgcctgtgtagatattatgccatcagttggttctcaaaagtattttaagtgcttcagatgtgtgttcccattatattttgaaaacatgaaaaatgctttaatgcatgtatgtaccagcagtggttacttgcattgtgtagtgtttttcaagaggtctgggtcttaacaaaatgttttcctttatctcagtgctcttctgcctctttttgttggtgtcctttgagaacaatacaccttctattccttcatttggttacacctttccttgtgacatttagcgagtttcaaacttacttccatatgaggctaagaaacctcaaatttcaggaattgggaaaaataaaattagcacttgcagaagtagcagcagatgggaaaatgccttgattgacattttctttcagcatttaaaatttttggcattttacagcttcatgacaaacagttttgtgcccataccttagaaaatgtggtgctgagttaaataaaggctgtttgagcactggagcagaaaaatgcattatttgcaaactggtggataattttgtgccttctcttctggccaccaagccagtgtagaaacagcaaaaatgtcataaaaattcttatatttaaaacaaaaacaaaagcaaaaacaaacattgaattaaattaagttttgtaattttaaactttaaaaacttctactgaaaatatttccgccaaatgccatcaatattttagactgtacctcgtttgcaaaactgctttgagagggaagagtggacaactcccatcagccttattctcttgagaactatattttggttcctagtaacagcctttccaaagctctactcttggtttttattactcataaatgtttaaattagaaaagaagggaccttgtacatgtgaaacctaattgactctctatattttggacaatttatgtatctgaaatgtgttgtctctgttatatgatgttatttttgccaggagactacaggttgatttagcttgatagctgaaatttgatggaaaactgatttccatttagtcttaccaagtgttgcttctctcttactagacagatatccacttagtaaaatctaaagcagtatgtaaatgaaaccagcaaagagagtagggtttattttataaacattcttaatgctaagtaaccagttgttcaatttattatatgtgtctgaggacattaaaacaccataaggttgtaataattggttgtgccaatgtgtgagggatttacctttaggctctctgtcaccagtgatttactagtgttagctgtttaacacattatctgtatttagtagtgattatttatttacaagttggtggtaattcagcagtcaggactctaagcttttatagttgaattgaggaaatctcgcttttattcatttagctggcaactgcctttattgcagacctctggtgcttggctttcaaggaagcctatgagatgccaaaatcacacctttagagagcaccttgctctaataggtgatgcatgagcaaacagtgagatttgaaggggttttaacataatttagaatgtgaaaaaaatatcaattcatatctttcaagtactaacccctcaaaaaagcccacacatacaaaatatgtgatgtgataccactttgtcttttaggtctttaagtaactgaagttaagcacagaaaaaaaaatcacttcatggaaatttcagtaagaaacccaaacttctaaaaattgcttgcagatgagctaaaaaaaaaaaaaaaaaaaaaaagcaacaaaataaccttttcatcagagttaaaagtagtgagaatctgttagttatacgtataccaaagtaaacattaaagagacatatcatgcaatttcaaagaattctttcatgctatttcttaacctgacatttctaactttattgcaggcaatatacaaagattggctcactactccataggttaattgaattcctggttgagaaactaacttgttttgttttccaaaattagctgaaatcttgtaaaacatgacttccctttaaaggatctagatattgttcaatttaaaatatggcaccataaaaaagtcatgtagtaatagagcatatgcttttttagaaccaggttaaaagctgtttgttatctaatagagtaaaagttactgaggtcaacagatagacaggtctggcataatatatgcccagtcataatagtctaattatattcttttgacaacagacagcattcatcagagcactaattcgaatgagagttttggctatcaagatgtgttgattctaaatattattgaatgagacctgattaaagtctgactttcctggccccagtgttttgcaggttggctatttccattatcagcccatcactccataaagttcttagctgcaccaagtgattggtgaacaaggacaacaacaaaagcagcatacattgtatggatttatctcaacgctattgtttaatggctgtgtttaatgtgatctatctggaaaatgaggactccgaataaaaagctattactaata

SEQ ID NO: 24823 - DNA, 5906 bp, Homo sapiens
gcaatcacgggtgtttagtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaaggtatctggaagtcgtgacacggtgtgtataaaacaaaagtttgcgagctgttaattgctgtgctgtgttattaagagacgctttcaagtttcaagtaccaaatgtagctttacgttgccaaaggaagttgaggcaattgctttgctgttttaacttgctctgtgagggaaatctcataaactgaccaatgcaccaaatgaatgctaaaatgcactttaggtttgtttttgcacttctgatagtatctttcaaccacgatgtactgggcaagaatttgaaatacaggatttatgaggaacagagggttggatcagtaattgcaagactatcagaggatgtggctgatgttttattgaagcttcctaatccttctactgttcgatttcgagccatgcagaggggaaattctcctctacttgtagtaaacgaggataatggggaaatcagcataggggctacaattgaccgtgaacaactgtgccagaaaaacttgaactgttccatagagtttgatgtgatcactctacccacagagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagctacgagcttcagctcactgcctcagacatgggagtacctcagaggtctggctcatccatactaaaaataagcatttcagactccaatgacaacagccctgcttttgagcagcaatcttatataatacaactcttagaaaactccccggttggcactttgctcttagatctgaatgccacggatccagatgagggcgctaatgggaaaattgtatattccttcagcagtcatgtgtctcccaaaattatggagacttttaaaattgattctgaaagaggacatttgactcttttcaagcaagtggattatgaaatcaccaaatcctatgagattgatgttcaggctcaagatttgggtccaaattcaatcccagcccattgcaaaattataattaaggttgtggatgttaatgacaataaacctgaaattaacatcaacctcatgtcccctggaaaagaagaaatatcttatatttttgaaggggatcctattgatacatttgttgctttggtcagagttcaggacaaggattctgggctgaatggagaaatagtttgtaagcttcatggacatggtcactttaaacttcagaagacatatgaaaacaattatttaatcttaactaatgccacactggatagagaaaagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgagcaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgttgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaagctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaattaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagtaaagctaaggaactgtctataagtcagagtcctgttcctacatatttgttcaaaagcttggcatgcagcaggcccttcctgagcgggtgattcagtgttgagtttcaaataataaacaggcagcattcagttggctgggcgaacaagaaaaacacaatggaaaaggaatgagtttgagacttgtaatgggaatgaaagtagtaagccatattccagctaaataagttaaatgcatttggggaataaagaaaaaagagtaagcaagcaataattgcttgaatatttttcaaattacaacaaaaaaaaatactttcttaggacattttgtattaaattgtgcaggataaaaaggtatccttacaatgtttccaggaggcaagaatattatcgtccctggcttgctagtcaggaattgaaacactgggaaagttaagtaactgaaaagtgactaaaattcagatatttgaattctcaaatgagtaccacattaaatagaatatattacctctttcaacaggcacattttcctttataggagagattgcaattacaagtgaaatttcagtatatttttcagtagattacacacacaaacgctaaccatatttaaatgcattctgcctttcaacttcacttcctttcagtatatattaccattaagaaaaagacttttatatcctcactgttcttaatttaaagcaccagcagtaatatgggaagctatgctgaaaaccgctattttgaataatgtgaaataaataaaatgcaatatttcattcaacacaaaa

SEQ ID NO: 24824 - DNA, 5887 bp, Homo sapiens
agtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaaggtatctggaagtcgtgacacggtgtgtataaaacaaaagtttgcgagctgttaattgctgtgctgtgttattaagagacgctttcaagtttcaagtaccaaatgtagctttacgttgccaaaggaagttgaggcaattgctttgctgttttaacttgctctgtgagggaaatctcataaactgaccaatgcaccaaatgaatgctaaaatgcactttaggtttgtttttgcacttctgatagtatctttcaaccacgatgtactgggcaagaatttgaaatacaggatttatgaggaacagagggttggatcagtaattgcaagactatcagaggatgtggctgatgttttattgaagcttcctaatccttctactgttcgatttcgagccatgcagaggggaaattctcctctacttgtagtaaacgaggataatggggaaatcagcataggggctacaattgaccgtgaacaactgtgccagaaaaacttgaactgttccatagagtttgatgtgatcactctacccacagagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagctacgagcttcagctcactgcctcagacatgggagtacctcagaggtctggctcatccatactaaaaataagcatttcagactccaatgacaacagccctgcttttgagcagcaatcttatataatacaactcttagaaaactccccggttggcactttgctcttagatctgaatgccacggatccagatgagggcgctaatgggaaaattgtatattccttcagcagtcatgtgtctcccaaaattatggagacttttaaaattgattctgaaagaggacatttgactcttttcaagcaagtggattatgaaatcaccaaatcctatgagattgatgttcaggctcaagatttgggtccaaattcaatcccagcccattgcaaaattataattaaggttgtggatgttaatgacaataaacctgaaattaacatcaacctcatgtcccctggaaaagaagaaatatcttatatttttgaaggggatcctattgatacatttgttgctttggtcagagttcaggacaaggattctgggctgaatggagaaatagtttgtaagcttcatggacatggtcactttaaacttcagaagacatatgaaaacaattatttaatcttaactaatgccacactggatagagaaaagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgttgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaagctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaattaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagtaaagctaaggaactgtctataagtcagagtcctgttcctacatatttgttcaaaagcttggcatgcagcaggcccttcctgagcgggtgattcagtgttgagtttcaaataataaacaggcagcattcagttggctgggcgaacaagaaaaacacaatggaaaaggaatgagtttgagacttgtaatgggaatgaaagtagtaagccatattccagctaaataagttaaatgcatttggggaataaagaaaaaagagtaagcaagcaataattgcttgaatatttttcaaattacaacaaaaaaaaatactttcttaggacattttgtattaaattgtgcaggataaaaaggtatccttacaatgtttccaggaggcaagaatattatcgtccctggcttgctagtcaggaattgaaacactgggaaagttaagtaactgaaaagtgactaaaattcagatatttgaattctcaaatgagtaccacattaaatagaatatattacctctttcaacaggcacattttcctttataggagagattgcaattacaagtgaaatttcagtatatttttcagtagattacacacacaaacgctaaccatatttaaatgcattctgcctttcaacttcacttcctttcagtatatattaccattaagaaaaagacttttatatcctcactgttcttaatttaaagcaccagcagtaatatgggaagctatgctgaaaaccgctattttgaataatgtgaaataaataaaatgcaatatttcattcaacacaaaa

SEQ ID NO: 24825 - DNA, 9613 bp, Homo sapiens
agtagtttgcggcatccggaggagcagcagcagcagtagcggcggcggctggcgcagcgcggagacggacgagcgggcacagacggcagcacagctcccgtgcaccatgcctggcttgcccgggaggcactggcacccgcgtccctagcccggcgctggcccttggcgcgttgcgctccgcagcattccggctgagcgatttcatccgaaatcctaaacctcctaccccaaacccattgcctcctgcttgctcatactccacactcacactccccacaccacacactcactcttcctctctctctcacacattcacacacagcccgagacagacagagaaagcgagacagacctcccgagtgcgcgagcgcccgggaggaagggagcccaacgcagcgcggccagcgcctctccgggaagatgaaatcaagacgctcctgcaagtaaacttcggcggcgacaaaatcgtcgactgtggcagctgctgaggcggaccccagcgacgtgcaactgagctaggagggcttcctcccgcggcggcggcggcggcggcggcggcggcggaccttggagcgacaccccagcccaaacggagagaagagaagcacccggtacccacggcggcggccccgcctctcctggccggtactgttgttgcctccccttccctcttccccattccccgccacccccggccattagaaagaccggggctttgattttcttggacaaattgccatctccccgtttccacaaacttgacgtggagggtcggactgcgttgttaactttgatttcctagacgaaaacgcccgcagaccctcaactgctctgtggggggaactccgctcccacctcggatcctggacagacgcgcccccaagcccttcgaagccagccttagcgcgagggagcgcgctcaagctctggcagcctctctcccctcccccttcctctgctggccccgggaccgccatccgactcaaccctataaccgggtgcccgcggcgcttgccagtaactgactcccgtctgcgacaccccctttctcccgaacaggcctcgaagaggccagtgtggcccccccagaccccggagggcgcattccaagcgggtactctctccgcagtgaactgggagcgctggggggaggtctttgcgcatgccaggtgcacagacagcgagttcgccagcctcagtgccggtgcaccgcggcgggccgggcagtgcctgaaaggctgcgcctcctccgccctctttaccttcgcctcaagtactgtccggactcagcggtgcgtcctccaggccgcgcagacgccgcccgacccgcagccctgggcggctgccgacagtcgcgcccggctaactttgaaggggtaaaactgagtagccgggctggagggagggggctcggggccgcgcggcgctcccttggcccctcggagcccccggggcccccgcgagcccccgccgcgtccgccgcaacctcagcattggagccgccgcgggtgtcccccgcgcgccgccgggccgccctgggcgggacttctcccgcggcctccggggccacggggcgcgcgcaacaggcggcccgagccggcgggaagctggagcgccgacggcgtcggtctcggaggggtgtggagaggcgaggccaggcagagccccgtgcagccatggagtcgctcctgctgccggtgctgctgctgctggccatactgtggacgcaggctgccgccctcattaatctcaagtactcggtagaagaggagcagcgcgccgggacggtgattgccaacgtggccaaagacgcgcgagaggcgggcttcgcgctggacccccggcaggcttcagcctttcgcgtggtgtccaactcggctccacacctagtggacatcaatcccagctctggcctgctggtcaccaagcagaagattgaccgtgatctgctgtgccgccagagccccaagtgcatcatctcgctcgaggtcatgtccagctcaatggaaatctgcgtgataaaggtggagatcaaggacctgaacgacaatgcgcccagtttcccggcagcacagatcgagctggagatctcggaggcagccagccctggcacgcgcatcccgctggacagcgcttacgatccagactcaggaagctttggcgtgcagacttacgagctcacgcccaacgagctgttcggcctggagatcaagacgcgcggcgacggctcccgctttgccgaactcgtggtggaaaagagcctggaccgcgagacgcagtcgcactacagcttccgaatcactgcgctagacggtggcgacccgccgcgcctgggcaccgttggccttagtatcaaggtgaccgactccaatgacaacaacccggtgtttagcgagtccacctacgcggtgagcgtgccagaaaactcgcctcccaacacacccgtcatccgcctcaacgccagcgatccagacgagggcaccaacggccaggtggtctactccttctatggctacgtcaacgaccgcacgcgcgagctctttcagatcgacccgcacagtggcctggtcactgtcactggcgctttagactacgaagaggggcacgtgtacgaactggacgtgcaggctaaggacttggggcccaattccatcccggcacactgcaaggtcaccgtcagcgtgctggacaccaatgacaatccgccggtcatcaacctgctgtcagtcaacagtgagcttgtggaggtcagcgagagcgcccccccgggctacgtgatcgccttggtgcgggtgtctgatcgcgactcaggcctcaatggacgtgtgcagtgccgtttgctgggcaatgtgccctttcgactgcaggaatatgagagcttctccactattctggtggacggacggctggaccgcgagcagcacgaccaatacaacctcacaattcaggcacgcgacggcggcgtgcccatgctgcagagtgccaagtcctttaccgtgctcatcactgacgaaaatgacaaccacccgcacttttccaagccctactaccaggtcattgtgcaggagaacaacacgcctggcgcctatctgctctctgtgtctgctcgcgaccccgacctgggtctcaacggcagtgtctcctaccagatcgtgccgtcgcaggtgcgggacatgcctgtcttcacctatgtctccatcaatcccaactcaggcgacatctacgcgctgcgatcctttaaccacgagcagaccaaggcgttcgaattcaaggtgctggccaaggacggcggccttccctcactgcaaagcaacgctacggtgcgggtcatcatcctcgacgtcaacgacaacaccccggtcatcacagccccacctctgattaacggcactgccgaggtctacataccccgcaactctggcataggctacctggtgactgttgtcaaggcagaagactacgatgagggcgaaaatggccgagtcacctacgacatgaccgagggcgaccgcggcttctttgaaatagaccaggtcaatggcgaagtcagaaccacccgcaccttcggggagagctccaagtcctcctatgagcttatcgtggtggctcacgaccacggcaagacatctctctctgcctctgctctcgtcctaatctacttgtcccctgctctcgatgcccaagagtcaatgggctctgtgaacttgtccttgattttcattattgccctgggctccattgcgggcatcctctttgtaactatgatcttcgtggcaatcaagtgcaagcgagacaacaaagagatccggacctacaactgcagaattgctgagtactcctatgggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgagactgaaaactattcttttgactccaactacgtgaatagccgagcccatttaatcaagagcagctccaccttcaaggacttagagggcaacagcctgaaggatagtggacatgaggagagtgaccaaactgacagtgagcatgatgtccagcggagcctgtattgtgatactgctgtcaacgatgtgctgaacaccagtgtgacctccatgggatctcagatgcctgatcatgatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatggttggttcttgagtggctatatttcagagcttttcctaaatgtattgtttataggtgattatcattctgtgacagtcccttgtttcaacaggcagcaggggtgttcagttggagcaaattagctttggcttgagttgttcatggggccttgatgttggggaaacagagacaaattcagttgtgaaaagtattatgtattaagtgtttgaatttatatatttttctatgtcaaaattataatataaattaccattgtttgtggaggattacatttaaaaaagcaaaaagtgaaaaaaaaaagctctggacacctttaataagctcgccactgttttttgtagtgtagacaagttaatggtcatttattgtgtactattcattgattcagtgatgtgaaattgagcccccaaaaggttgtttctgaagctcgagtacttcccaatgccgctactttgctgtggacacccctgctttaaaaacccttttgctagctgtgctattgttgtatttgatattgcaaattgctatgtgtgtggtgatggcaaaaggcttttaaaagttggtgttttctttttcttaaaaaaataataaaactacagacaaaaacaaagtgcaaacaactgagacagcaaatgaatgagcaacaccatgcatatagattgagtacttggagaatactcacgttttttaactcatgtagtgattgctcaccactttgcaaagtatttttcctgcctttcagtggtctgcccaggtccatgatagatcattgcagaaagtcatttttggataggctgctatctaatttgcagttgtcagaaatactgtgctgaaagttttatgacatccatcttttaaattttcaggccctgaacaggaaagttgctcctgaagttatgtttccaggcttagaaattccctctctccaatcatctaaaattgaagatgactgaatctattttaagatctaaattagcatctcttcagacacacacttcctgattcagtgtttcccaatcatgattagaattagactgcaaagcacgtcatgggctgggattgagaactccatgttgctctgtatcttaggcttatatacgtagggatagagtaagcagtacaaagtgtatattttggaaaagacaggtaacaggtaacagcatcgctaatccaattactgtgccttctaaacggagacactcagacacttgaactcatctttttatgactaatagttttttgattaaaaatgtgaacaagaaaatactaaaataaaaatcctttcgatttagccaactctttttgctgtaggctaggaatacaccctttttaaattaacacactgtagatcctttttttctgttttaacattcctctaactcccccatttatcttttgtctattaatattcactagccaacatagtatttttgcagcctaagagttcattatttaaaaataaactaaagaaatatgtcacctttgttctgccttggtcttaagagagttgtttctagagaaacaagttttatggttctgttttcatttgtttcattttttgaaattcaggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtgggtaaggcagtagggatggggttaggtaggggagaacatttctgaaaaagaacttataatgaagctacaaatccatccttatttcttattcagtgctgaatactacctcatgcaaaatattggtgtggctgcaaatttccctctgaagctgacacaattaaggatgaattaccataacatcttcatttttcctcatttcattgcctctcatacagttttctccctctgatttatttcattttggtagtggattttgaattaagtatttatttctctttgcaagtgactatttgattaacacattaaaaattttttaaaaatttcccctttaagttatgatggctgcctatagaatttagactgtttctcaccctgatccatcctgatattatgttattagctacgatttcaaggtcactttgaagtcagacttcacagttttctacaggtgtatttcttgctatgctcagtgggaaccagggagcagaaaagattgtggaaagtgggaacattaattgtcacgtggctgttgagccagagaggccactggctgccatgcctcttaccagccaagttttaaatggttagagtggcattggcattgattttgcttttctcttgggttttcttcatttcttttcataattcatcttcaagctatagatccatccttcttccctatccaaatactttgttctcagtgggcagtcagatttttttggcttccaaacctcactgagcatgttcagagaattcctctcattaaggaaatatttttccccacaattgtctgatgtatgagtcctctcagaagcacaagtgcatactaggaaggctttgtaaactggttttgtaggcaggctgtacctgcaaataggcattctgagcaaggatcctaaatttccctttggctcatgtcccccccgccccaccccaccttctcctttttggcatgtctggtgaaaagctacaaggttcacagggccaaatattctcccttttgttctctaaacatgttgcacacataaactcaagggagtgatttcggttcctaagtcctagggagttctattccatttattctgatgtcccttttaaggaggagttggtgttgaagtgtgacatgctttaatgataactgctttggcaattccccagacaggtatacttcttcatccaaaattgcacctaaggtgttcatttagacaaaattgttcgcttagtgatccactgatctctaatcagaaatatttttaaaaaatacaatttagatctctgaaaattggaaccactcaagagtatcatcttgatagtgttacttcagcatatgactgactgattttatgaagggagtttagctgacttttccctgtagccctatcatattaaaaacaaaaagtggtccacttgaagcagcaaggacaaagggcagtttagggagaggcagggtgaaggggatagctcgattgggcatccagagtggaaaaggattattattgtacataatagcagttctggctggaattccaatccactttctggggatcattttgatgttgaatgttcccccaaagcattctgacaagtttggtccacttggctctttaccccgggtaataagacccttattgactttgaaaaactggcataaatgagcttaagaaatccattgtatacagtcctagtgtttgccttcttggtaaaattacatttaaggatgtcatttcatgagtcaaattgtatctgctgacactgaagtgtattgagatgttgttctttagtttaagtatgtaacaaagtaatattcaaaggggatgtttgggggtggggctgggaccgggtggctttatattgataatgaaatattccagagcaaaacacattgtcctaatgaagttgttgcagctctcttcgttttcttgtgccgctggaattggcttgtgggtcacttgttgtgcaaaagtgaattaatttcaaataggaatcatattgcttttgtgaaacaaagaaaatttaccaccttgtctgatacatagattggaaggcgctcttggtaaagaataacccacaaacacctgatcttgattggaaagcattgtaggtcattagggaaaactgatgatgctgactgttgctccagctgtgttggcaattcaagatgaccttgttactaactgaaagttgctgtcaaccttagcaaacaaaccagctaacaccattacagcactggttaagtagatttttactggcactggctggcgttcagctgaggaaggctaggatacagactttaatgaccaagagccagactagctcgagctagaaatcagcaacaaatacctccttgtgctatttgaatgctaaggtattagttgcaataggcttacgccttcgctcctctagtgaggggaatgagcctgatgacactattactgtttacctgtcaaaccagggtggaaatttagagggatgcaagtacagtatgtctcattaagcagtctctgttgctgattatatgaagataaaattgttgtatatgctgatctgtatgttatgtacattttcacagtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaag

SEQ ID NO: 24826 - DNA, 9756 bp, Homo sapiens
agtagtttgcggcatccggaggagcagcagcagcagtagcggcggcggctggcgcagcgcggagacggacgagcgggcacagacggcagcacagctcccgtgcaccatgcctggcttgcccgggaggcactggcacccgcgtccctagcccggcgctggcccttggcgcgttgcgctccgcagcattccggctgagcgatttcatccgaaatcctaaacctcctaccccaaacccattgcctcctgcttgctcatactccacactcacactccccacaccacacactcactcttcctctctctctcacacattcacacacagcccgagacagacagagaaagcgagacagacctcccgagtgcgcgagcgcccgggaggaagggagcccaacgcagcgcggccagcgcctctccgggaagatgaaatcaagacgctcctgcaagtaaacttcggcggcgacaaaatcgtcgactgtggcagctgctgaggcggaccccagcgacgtgcaactgagctaggagggcttcctcccgcggcggcggcggcggcggcggcggcggcggaccttggagcgacaccccagcccaaacggagagaagagaagcacccggtacccacggcggcggccccgcctctcctggccggtactgttgttgcctccccttccctcttccccattccccgccacccccggccattagaaagaccggggctttgattttcttggacaaattgccatctccccgtttccacaaacttgacgtggagggtcggactgcgttgttaactttgatttcctagacgaaaacgcccgcagaccctcaactgctctgtggggggaactccgctcccacctcggatcctggacagacgcgcccccaagcccttcgaagccagccttagcgcgagggagcgcgctcaagctctggcagcctctctcccctcccccttcctctgctggccccgggaccgccatccgactcaaccctataaccgggtgcccgcggcgcttgccagtaactgactcccgtctgcgacaccccctttctcccgaacaggcctcgaagaggccagtgtggcccccccagaccccggagggcgcattccaagcgggtactctctccgcagtgaactgggagcgctggggggaggtctttgcgcatgccaggtgcacagacagcgagttcgccagcctcagtgccggtgcaccgcggcgggccgggcagtgcctgaaaggctgcgcctcctccgccctctttaccttcgcctcaagtactgtccggactcagcggtgcgtcctccaggccgcgcagacgccgcccgacccgcagccctgggcggctgccgacagtcgcgcccggctaactttgaaggggtaaaactgagtagccgggctggagggagggggctcggggccgcgcggcgctcccttggcccctcggagcccccggggcccccgcgagcccccgccgcgtccgccgcaacctcagcattggagccgccgcgggtgtcccccgcgcgccgccgggccgccctgggcgggacttctcccgcggcctccggggccacggggcgcgcgcaacaggcggcccgagccggcgggaagctggagcgccgacggcgtcggtctcggaggggtgtggagaggcgaggccaggcagagccccgtgcagccatggagtcgctcctgctgccggtgctgctgctgctggccatactgtggacgcaggctgccgccctcattaatctcaagtactcggtagaagaggagcagcgcgccgggacggtgattgccaacgtggccaaagacgcgcgagaggcgggcttcgcgctggacccccggcaggcttcagcctttcgcgtggtgtccaactcggctccacacctagtggacatcaatcccagctctggcctgctggtcaccaagcagaagattgaccgtgatctgctgtgccgccagagccccaagtgcatcatctcgctcgaggtcatgtccagctcaatggaaatctgcgtgataaaggtggagatcaaggacctgaacgacaatgcgcccagtttcccggcagcacagatcgagctggagatctcggaggcagccagccctggcacgcgcatcccgctggacagcgcttacgatccagactcaggaagctttggcgtgcagacttacgagctcacgcccaacgagctgttcggcctggagatcaagacgcgcggcgacggctcccgctttgccgaactcgtggtggaaaagagcctggaccgcgagacgcagtcgcactacagcttccgaatcactgcgctagacggtggcgacccgccgcgcctgggcaccgttggccttagtatcaaggtgaccgactccaatgacaacaacccggtgtttagcgagtccacctacgcggtgagcgtgccagaaaactcgcctcccaacacacccgtcatccgcctcaacgccagcgatccagacgagggcaccaacggccaggtggtctactccttctatggctacgtcaacgaccgcacgcgcgagctctttcagatcgacccgcacagtggcctggtcactgtcactggcgctttagactacgaagaggggcacgtgtacgaactggacgtgcaggctaaggacttggggcccaattccatcccggcacactgcaaggtcaccgtcagcgtgctggacaccaatgacaatccgccggtcatcaacctgctgtcagtcaacagtgagcttgtggaggtcagcgagagcgcccccccgggctacgtgatcgccttggtgcgggtgtctgatcgcgactcaggcctcaatggacgtgtgcagtgccgtttgctgggcaatgtgccctttcgactgcaggaatatgagagcttctccactattctggtggacggacggctggaccgcgagcagcacgaccaatacaacctcacaattcaggcacgcgacggcggcgtgcccatgctgcagagtgccaagtcctttaccgtgctcatcactgacgaaaatgacaaccacccgcacttttccaagccctactaccaggtcattgtgcaggagaacaacacgcctggcgcctatctgctctctgtgtctgctcgcgaccccgacctgggtctcaacggcagtgtctcctaccagatcgtgccgtcgcaggtgcgggacatgcctgtcttcacctatgtctccatcaatcccaactcaggcgacatctacgcgctgcgatcctttaaccacgagcagaccaaggcgttcgaattcaaggtgctggccaaggacggcggccttccctcactgcaaagcaacgctacggtgcgggtcatcatcctcgacgtcaacgacaacaccccggtcatcacagccccacctctgattaacggcactgccgaggtctacataccccgcaactctggcataggctacctggtgactgttgtcaaggcagaagactacgatgagggcgaaaatggccgagtcacctacgacatgaccgagggcgaccgcggcttctttgaaatagaccaggtcaatggcgaagtcagaaccacccgcaccttcggggagagctccaagtcctcctatgagcttatcgtggtggctcacgaccacggcaagacatctctctctgcctctgctctcgtcctaatctacttgtcccctgctctcgatgcccaagagtcaatgggctctgtgaacttgtccttgattttcattattgccctgggctccattgcgggcatcctctttgtaactatgatcttcgtggcaatcaagtgcaagcgagacaacaaagagatccggacctacaactgcagtaattgtttaaccatcacttgtctcctcggctgttttataaaaggacaaaacagcaagtgtctgcattgcatctcggtttctcccattagcgaggagcaagacaaaaagacagaggagaaagtgagcctaaggggaaagagaattgctgagtactcctatgggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgagactgaaaactattcttttgactccaactacgtgaatagccgagcccatttaatcaagagcagctccaccttcaaggacttagagggcaacagcctgaaggatagtggacatgaggagagtgaccaaactgacagtgagcatgatgtccagcggagcctgtattgtgatactgctgtcaacgatgtgctgaacaccagtgtgacctccatgggatctcagatgcctgatcatgatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatggttggttcttgagtggctatatttcagagcttttcctaaatgtattgtttataggtgattatcattctgtgacagtcccttgtttcaacaggcagcaggggtgttcagttggagcaaattagctttggcttgagttgttcatggggccttgatgttggggaaacagagacaaattcagttgtgaaaagtattatgtattaagtgtttgaatttatatatttttctatgtcaaaattataatataaattaccattgtttgtggaggattacatttaaaaaagcaaaaagtgaaaaaaaaaagctctggacacctttaataagctcgccactgttttttgtagtgtagacaagttaatggtcatttattgtgtactattcattgattcagtgatgtgaaattgagcccccaaaaggttgtttctgaagctcgagtacttcccaatgccgctactttgctgtggacacccctgctttaaaaacccttttgctagctgtgctattgttgtatttgatattgcaaattgctatgtgtgtggtgatggcaaaaggcttttaaaagttggtgttttctttttcttaaaaaaataataaaactacagacaaaaacaaagtgcaaacaactgagacagcaaatgaatgagcaacaccatgcatatagattgagtacttggagaatactcacgttttttaactcatgtagtgattgctcaccactttgcaaagtatttttcctgcctttcagtggtctgcccaggtccatgatagatcattgcagaaagtcatttttggataggctgctatctaatttgcagttgtcagaaatactgtgctgaaagttttatgacatccatcttttaaattttcaggccctgaacaggaaagttgctcctgaagttatgtttccaggcttagaaattccctctctccaatcatctaaaattgaagatgactgaatctattttaagatctaaattagcatctcttcagacacacacttcctgattcagtgtttcccaatcatgattagaattagactgcaaagcacgtcatgggctgggattgagaactccatgttgctctgtatcttaggcttatatacgtagggatagagtaagcagtacaaagtgtatattttggaaaagacaggtaacaggtaacagcatcgctaatccaattactgtgccttctaaacggagacactcagacacttgaactcatctttttatgactaatagttttttgattaaaaatgtgaacaagaaaatactaaaataaaaatcctttcgatttagccaactctttttgctgtaggctaggaatacaccctttttaaattaacacactgtagatcctttttttctgttttaacattcctctaactcccccatttatcttttgtctattaatattcactagccaacatagtatttttgcagcctaagagttcattatttaaaaataaactaaagaaatatgtcacctttgttctgccttggtcttaagagagttgtttctagagaaacaagttttatggttctgttttcatttgtttcattttttgaaattcaggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtgggtaaggcagtagggatggggttaggtaggggagaacatttctgaaaaagaacttataatgaagctacaaatccatccttatttcttattcagtgctgaatactacctcatgcaaaatattggtgtggctgcaaatttccctctgaagctgacacaattaaggatgaattaccataacatcttcatttttcctcatttcattgcctctcatacagttttctccctctgatttatttcattttggtagtggattttgaattaagtatttatttctctttgcaagtgactatttgattaacacattaaaaattttttaaaaatttcccctttaagttatgatggctgcctatagaatttagactgtttctcaccctgatccatcctgatattatgttattagctacgatttcaaggtcactttgaagtcagacttcacagttttctacaggtgtatttcttgctatgctcagtgggaaccagggagcagaaaagattgtggaaagtgggaacattaattgtcacgtggctgttgagccagagaggccactggctgccatgcctcttaccagccaagttttaaatggttagagtggcattggcattgattttgcttttctcttgggttttcttcatttcttttcataattcatcttcaagctatagatccatccttcttccctatccaaatactttgttctcagtgggcagtcagatttttttggcttccaaacctcactgagcatgttcagagaattcctctcattaaggaaatatttttccccacaattgtctgatgtatgagtcctctcagaagcacaagtgcatactaggaaggctttgtaaactggttttgtaggcaggctgtacctgcaaataggcattctgagcaaggatcctaaatttccctttggctcatgtcccccccgccccaccccaccttctcctttttggcatgtctggtgaaaagctacaaggttcacagggccaaatattctcccttttgttctctaaacatgttgcacacataaactcaagggagtgatttcggttcctaagtcctagggagttctattccatttattctgatgtcccttttaaggaggagttggtgttgaagtgtgacatgctttaatgataactgctttggcaattccccagacaggtatacttcttcatccaaaattgcacctaaggtgttcatttagacaaaattgttcgcttagtgatccactgatctctaatcagaaatatttttaaaaaatacaatttagatctctgaaaattggaaccactcaagagtatcatcttgatagtgttacttcagcatatgactgactgattttatgaagggagtttagctgacttttccctgtagccctatcatattaaaaacaaaaagtggtccacttgaagcagcaaggacaaagggcagtttagggagaggcagggtgaaggggatagctcgattgggcatccagagtggaaaaggattattattgtacataatagcagttctggctggaattccaatccactttctggggatcattttgatgttgaatgttcccccaaagcattctgacaagtttggtccacttggctctttaccccgggtaataagacccttattgactttgaaaaactggcataaatgagcttaagaaatccattgtatacagtcctagtgtttgccttcttggtaaaattacatttaaggatgtcatttcatgagtcaaattgtatctgctgacactgaagtgtattgagatgttgttctttagtttaagtatgtaacaaagtaatattcaaaggggatgtttgggggtggggctgggaccgggtggctttatattgataatgaaatattccagagcaaaacacattgtcctaatgaagttgttgcagctctcttcgttttcttgtgccgctggaattggcttgtgggtcacttgttgtgcaaaagtgaattaatttcaaataggaatcatattgcttttgtgaaacaaagaaaatttaccaccttgtctgatacatagattggaaggcgctcttggtaaagaataacccacaaacacctgatcttgattggaaagcattgtaggtcattagggaaaactgatgatgctgactgttgctccagctgtgttggcaattcaagatgaccttgttactaactgaaagttgctgtcaaccttagcaaacaaaccagctaacaccattacagcactggttaagtagatttttactggcactggctggcgttcagctgaggaaggctaggatacagactttaatgaccaagagccagactagctcgagctagaaatcagcaacaaatacctccttgtgctatttgaatgctaaggtattagttgcaataggcttacgccttcgctcctctagtgaggggaatgagcctgatgacactattactgtttacctgtcaaaccagggtggaaatttagagggatgcaagtacagtatgtctcattaagcagtctctgttgctgattatatgaagataaaattgttgtatatgctgatctgtatgttatgtacattttcacagtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaagta

SEQ ID NO: 24827 - DNA, 7936 bp, Homo sapiens
atggagtcgctcctgctgccggtgctgctgctgctggccatactgtggacgcaggctgccgccctcattaatctcaagtactcggtagaagaggagcagcgcgccgggacggtgattgccaacgtggccaaagacgcgcgagaggcgggcttcgcgctggacccccggcaggcttcagcctttcgcgtggtgtccaactcggctccacacctagtggacatcaatcccagctctggcctgctggtcaccaagcagaagattgaccgtgatctgctgtgccgccagagccccaagtgcatcatctcgctcgaggtcatgtccagctcaatggaaatctgcgtgataaaggtggagatcaaggacctgaacgacaatgcgcccagtttcccggcagcacagatcgagctggagatctcggaggcagccagccctggcacgcgcatcccgctggacagcgcttacgatccagactcaggaagctttggcgtgcagacttacgagctcacgcccaacgagctgttcggcctggagatcaagacgcgcggcgacggctcccgctttgccgaactcgtggtggaaaagagcctggaccgcgagacgcagtcgcactacagcttccgaatcactgcgctagacggtggcgacccgccgcgcctgggcaccgttggccttagtatcaaggtgaccgactccaatgacaacaacccggtgtttagcgagtccacctacgcggtgagcgtgccagaaaactcgcctcccaacacacccgtcatccgcctcaacgccagcgatccagacgagggcaccaacggccaggtggtctactccttctatggctacgtcaacgaccgcacgcgcgagctctttcagatcgacccgcacagtggcctggtcactgtcactggcgctttagactacgaagaggggcacgtgtacgaactggacgtgcaggctaaggacttggggcccaattccatcccggcacactgcaaggtcaccgtcagcgtgctggacaccaatgacaatccgccggtcatcaacctgctgtcagtcaacagtgagcttgtggaggtcagcgagagcgcccccccgggctacgtgatcgccttggtgcgggtgtctgatcgcgactcaggcctcaatggacgtgtgcagtgccgtttgctgggcaatgtgccctttcgactgcaggaatatgagagcttctccactattctggtggacggacggctggaccgcgagcagcacgaccaatacaacctcacaattcaggcacgcgacggcggcgtgcccatgctgcagagtgccaagtcctttaccgtgctcatcactgacgaaaatgacaaccacccgcacttttccaagccctactaccaggtcattgtgcaggagaacaacacgcctggcgcctatctgctctctgtgtctgctcgcgaccccgacctgggtctcaacggcagtgtctcctaccagatcgtgccgtcgcaggtgcgggacatgcctgtcttcacctatgtctccatcaatcccaactcaggcgacatctacgcgctgcgatcctttaaccacgagcagaccaaggcgttcgaattcaaggtgctggccaaggacggcggccttccctcactgcaaagcaacgctacggtgcgggtcatcatcctcgacgtcaacgacaacaccccggtcatcacagccccacctctgattaacggcactgccgaggtctacataccccgcaactctggcataggctacctggtgactgttgtcaaggcagaagactacgatgagggcgaaaatggccgagtcacctacgacatgaccgagggcgaccgcggcttctttgaaatagaccaggtcaatggcgaagtcagaaccacccgcaccttcggggagagctccaagtcctcctatgagcttatcgtggtggctcacgaccacggcaagacatctctctctgcctctgctctcgtcctaatctacttgtcccctgctctcgatgcccaagagtcaatgggctctgtgaacttgtccttgattttcattattgccctgggctccattgcgggcatcctctttgtaactatgatcttcgtggcaatcaagtgcaagcgagacaacaaagagatccggacctacaactgcagaattgctgagtactcctatgggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgagactgaaaactattcttttgactccaactacgtgaatagccgagcccatttaatcaagagctccaccttcaaggacttagagggcaacagcctgaaggatagtggacatgaggagagtgaccaaactgacagtgagcatgatgtccagcggagcctgtattgtgatactgctgtcaacgatgtgctgaacaccagtgtgacctccatgggatctcagatgcctgatcatgatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatggttggttcttgagtggctatatttcagagcttttcctaaatgtattgtttataggtgattatcattctgtgacagtcccttgtttcaacaggcagcaggggtgttcagttggagcaaattagctttggcttgagttgttcatggggccttgatgttggggaaacagagacaaattcagttgtgaaaagtattatgtattaagtgtttgaatttatatatttttctatgtcaaaattataatataaattaccattgtttgtggaggattacatttaaaaaagcaaaaagtgaaaaaaaaaagctctggacacctttaataagctcgccactgttttttgtagtgtagacaagttaatggtcatttattgtgtactattcattgattcagtgatgtgaaattgagcccccaaaaggttgtttctgaagctcgagtacttcccaatgccgctactttgctgtggacacccctgctttaaaaacccttttgctagctgtgctattgttgtatttgatattgcaaattgctatgtgtgtggtgatggcaaaaggcttttaaaagttggtgttttctttttcttaaaaaaataataaaactacagacaaaaacaaagtgcaaacaactgagacagcaaatgaatgagcaacaccatgcatatagattgagtacttggagaatactcacgttttttaactcatgtagtgattgctcaccactttgcaaagtatttttcctgcctttcagtggtctgcccaggtccatgatagatcattgcagaaagtcatttttggataggctgctatctaatttgcagttgtcagaaatactgtgctgaaagttttatgacatccatcttttaaattttcaggccctgaacaggaaagttgctcctgaagttatgtttccaggcttagaaattccctctctccaatcatctaaaattgaagatgactgaatctattttaagatctaaattagcatctcttcagacacacacttcctgattcagtgtttcccaatcatgattagaattagactgcaaagcacgtcatgggctgggattgagaactccatgttgctctgtatcttaggcttatatacgtagggatagagtaagcagtacaaagtgtatattttggaaaagacaggtaacaggtaacagcatcgctaatccaattactgtgccttctaaacggagacactcagacacttgaactcatctttttatgactaatagttttttgattaaaaatgtgaacaagaaaatactaaaataaaaatcctttcgatttagccaactctttttgctgtaggctaggaatacaccctttttaaattaacacactgtagatcctttttttctgttttaacattcctctaactcccccatttatcttttgtctattaatattcactagccaacatagtatttttgcagcctaagagttcattatttaaaaataaactaaagaaatatgtcacctttgttctgccttggtcttaagagagttgtttctagagaaacaagttttatggttctgttttcatttgtttcattttttgaaattcaggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtgggtaaggcagtagggatggggttaggtaggggagaacatttctgaaaaagaacttataatgaagctacaaatccatccttatttcttattcagtgctgaatactacctcatgcaaaatattggtgtggctgcaaatttccctctgaagctgacacaattaaggatgaattaccataacatcttcatttttcctcatttcattgcctctcatacagttttctccctctgatttatttcattttggtagtggattttgaattaagtatttatttctctttgcaagtgactatttgattaacacattaaaaattttttaaaaatttcccctttaagttatgatggctgcctatagaatttagactgtttctcaccctgatccatcctgatattatgttattagctacgatttcaaggtcactttgaagtcagacttcacagttttctacaggtgtatttcttgctatgctcagtgggaaccagggagcagaaaagattgtggaaagtgggaacattaattgtcacgtggctgttgagccagagaggccactggctgccatgcctcttaccagccaagttttaaatggttagagtggcattggcattgattttgcttttctcttgggttttcttcatttcttttcataattcatcttcaagctatagatccatccttcttccctatccaaatactttgttctcagtgggcagtcagatttttttggcttccaaacctcactgagcatgttcagagaattcctctcattaaggaaatatttttccccacaattgtctgatgtatgagtcctctcagaagcacaagtgcatactaggaaggctttgtaaactggttttgtaggcaggctgtacctgcaaataggcattctgagcaaggatcctaaatttccctttggctcatgtcccccccgccccaccccaccttctcctttttggcatgtctggtgaaaagctacaaggttcacagggccaaatattctcccttttgttctctaaacatgttgcacacataaactcaagggagtgatttcggttcctaagtcctagggagttctattccatttattctgatgtcccttttaaggaggagttggtgttgaagtgtgacatgctttaatgataactgctttggcaattccccagacaggtatacttcttcatccaaaattgcacctaaggtgttcatttagacaaaattgttcgcttagtgatccactgatctctaatcagaaatatttttaaaaaatacaatttagatctctgaaaattggaaccactcaagagtatcatcttgatagtgttacttcagcatatgactgactgattttatgaagggagtttagctgacttttccctgtagccctatcatattaaaaacaaaaagtggtccacttgaagcagcaaggacaaagggcagtttagggagaggcagggtgaaggggatagctcgattgggcatccagagtggaaaaggattattattgtacataatagcagttctggctggaattccaatccactttctggggatcattttgatgttgaatgttcccccaaagcattctgacaagtttggtccacttggctctttaccccgggtaataagacccttattgactttgaaaaactggcataaatgagcttaagaaatccattgtatacagtcctagtgtttgccttcttggtaaaattacatttaaggatgtcatttcatgagtcaaattgtatctgctgacactgaagtgtattgagatgttgttctttagtttaagtatgtaacaaagtaatattcaaaggggatgtttgggggtggggctgggaccgggtggctttatattgataatgaaatattccagagcaaaacacattgtcctaatgaagttgttgcagctctcttcgttttcttgtgccgctggaattggcttgtgggtcacttgttgtgcaaaagtgaattaatttcaaataggaatcatattgcttttgtgaaacaaagaaaatttaccaccttgtctgatacatagattggaaggcgctcttggtaaagaataacccacaaacacctgatcttgattggaaagcattgtaggtcattagggaaaactgatgatgctgactgttgctccagctgtgttggcaattcaagatgaccttgttactaactgaaagttgctgtcaaccttagcaaacaaaccagctaacaccattacagcactggttaagtagatttttactggcactggctggcgttcagctgaggaaggctaggatacagactttaatgaccaagagccagactagctcgagctagaaatcagcaacaaatacctccttgtgctatttgaatgctaaggtattagttgcaataggcttacgccttcgctcctctagtgaggggaatgagcctgatgacactattactgtttacctgtcaaaccagggtggaaatttagagggatgcaagtacagtatgtctcattaagcagtctctgttgctgattatatgaagataaaattgttgtatatgctgatctgtatgttatgtacattttcacagtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaagta

SEQ ID NO: 24828 - DNA, 2942 bp, Homo sapiens
gaatgcgcggccgagggaatgcgcgcagctcacaggccctgggagtgagctggtgcccggcgacctggcacccgcgcctggatatggggcgtctacatcgtcccaggagcagcaccagctacaggaacctgccgcatctgtttctgtttttcctcttcgtgggacccttcagctgccagagcgcaccggtgctgagtggaacccccctctctccttcagcctggcctcccggggactgagtggccagtacgtgaccctagacaaccgctctggggagctgcacacttcagctcaggagatcgacagggaggccctgtgtgttgaagggggtggagggactgcgtggagcggcagcgtttccatctcctcctctccttctgactcttgtcttttgctgctggatgtgcttgtcctgcctcaggaatacttcaggtttgtgaaggtgaagatcgccatcagagacatcaatgacaacgccccgcagttccctgtttcccagatctcggtgtgggtcccggaaaatgcacctgtaaacacccgactggccatagagcatcctgctgtggacccagatgtaggcattaatggggtacagacctatcgcttactggactaccatggtatgttcaccctggacgtggaggagaatgagaatggggagcgcaccccctacctaattgtcatgggtgctttggacagggaaacccaggaccagtatgtgagcatcatcatagctgaggatggtgggtctccaccacttttgggcagtgccactctcaccattggcatcagtgacattaatgacaattgccctctcttcacagactcacaaatcaatgtcactgtgtatgggaatgctacagtgggcaccccaattgcagctgtccaggctgtggataaagacttggggaccaatgctcaaattacttattcttacagtcagaaagttccacaagcatctaaggatttatttcacctggatgaaaacactggagtcattaaacttttcagtaagattggaggaagtgttctggagtcccacaagctcaccatccttgctaatggaccaggctgcatccctgctgtaatcactgctcttgtgtccattattaaagttattttcagaccccctgaaattgtccctcgttacatagcaaacgagatagatggtgtggtttatctgaaagaactggaacccgttaacactcccattgcgtttttcaccataagagatccagaaggtaaatacaaggttaactgctacctggatggtgaagggccgtttaggttatcaccttacaaaccatacaataatgaatatttactagagaccacaaaacctatggactatgagctacagcagttctatgaagtagctgtggtggcttggaactctgagggatttcatgtcaaaagggtcattaaagtgcaacttttagatgacaatgataatgctccaattttccttcaacccttaatagaactaaccatcgaagagaacaactcacccaatgcctttttgactaagctgtatgctacagatgccgacagcgaggagagaggccaagtttcatattttctgggacctgatgctccatcatatttttccttagacagtgtcacaggaattctgacagtttctactcagctggaccgagaagagaaagaaaagtacagatacactgtcagagctgttgactgtgggaagccacccagagaatcagtagccactgtggccctcacagtgttggataaaaatgacaacagtcctcggtttatcaacaaggacttcagcttttttgtgcctgaaaactttccaggctatggtgagattggagtaattagtgtaacagatgctgacgctggacgaaatggatgggtcgccctctctgtggtgaaccagagtgatatttttgtcatagatacaggaaagggtatgctgagggctaaagtctctttggacagagagcagcaaagctcctatactttgtgggttgaagctgttgatgggggtgagcctgccctctcctctacagcaaaaatcacaattctccttctagatatcaatgacaaccctcctcttgttttgtttcctcagtctaatatgtcttatctgttagtactgccttctactctgccaggctccccggttacagaagtctatgctgtcgacaaagacacaggcatgaatgctgtcatagcttacagcatcatagggagaagaggtcctaggcctgagtccttcaggattgaccctaaaactggcaacattactttggaagaggcattgctgcagacagattatgggctccatcgcttactggtgaaagtgagtgatcatggttatcccgagcctctccactccacagtcatggtgaacctatttgtcaatgacactgtcagtaatgagagttacattgagagtcttttaagaaaagaaccagagattaatatagaggagaaagaaccacaaatctcaatagaaccgactcataggaaggtagaatctgtgtcttgtatgcccaccttagtagctctgtctgtaataagcttgggttccatcacactggtcacagggatgggcatatacatctgtttaaggaaaggggaaaagcatcccagggaagatgaaaatttggaagtacagattccactgaaaggaaaaattgacttgcatatgcgagagagaaagccaatggatatttctaatatttgatatttcatggtggaataacacagagaaatgttttaactgactttggatcttcatcacctaaaaaagagtgtgttgatggcagttccaatgaaggacaactaatttataacttgttctatattgtaaatagctgtttacaggtttttaaatttaaattcagaggttataaaatgtgtacagcatttttaagtgaaaattagtactaacagctataggacttgtattt

SEQ ID NO: 24829 - DNA, 6347 bp, Homo sapiens
ataaaatattgcatattgacagcaatatcccagtggctgatttattgataatatctttgaccatttgaattttttttcctattatatataaggaaatacaaactaggtaacaggaagaaatgagaaaaggtagagagagacaatagtgaagactggtggacattggactacaaaagattactgcaggattcttctatgatgctgattacagctttatcttatcaagctttggcattgaagaccatgtgaattcatctccaaccctgggagtgaaataagaactttcttttttgcttctgaaattttaagctctatacggaaacactttttacttaatctgcatgacatcagagaaagggaacaatttgaccaaagaaagaagaaaaagtggattagcagatctcatggactgagagtctccagatggtaggaggtccattcagcagaaatacaaatgagaatacgatgtttctaatgtatttaatttggagaaaaacattttcacattttttcaataagcaaagttaatcacattacattttacctttggtaaaagaatattaattaaattgattatgctcacactagagaacaatataacatatcatagtcaaataacgtttatgtttatattcattattacaagcattaaaaagaaataaatagtgttggcagatattacttaagcaggcagagtctcctatatctggaaatttatcatttatactgctagagttaaggatattttaatagtatttaattaactaaaatttaagagattactgctttcagccatttaaaaattattaattgaacgttgactacctgcttggtctgtgtttaccattatccattaagagcttgttatttaattggggaaatccaagtcaagatacagtaaatacgcaagaaacttatcaaatatttgaataaaaataatggcacccatattttatggtgtatttatagtattgttcctgaaaaaataagaaaaactattaatatccccctccaaaaacacatggaagaaatttcccatttttaaaaattattaatattctcatctaataaatgctatttggaactatcatattggaaataaataaaatacctttaatccaataatgatatcattgaagaaatgagtaccctcatatagttacagtgctattataaataactaaaatttctggaggtatttgttttacatataccagaaagtcttaaaattttacattccagttaaaacatatattcaatatttagtaattcatgctaaattatcataaatatttccaaagatgtcgataaaataagcctcactgaaaatatatttatataaaatattgaacaagtaaaatgttcatatccacattacaaactgatatgaggaaattctattctgtccaaaaatgatacagaatacgtaaagacatgcaaaatgattataacataataaaacataaattagatgatttttaaaatctctaagttcagtaaaaatccagagaaatcaaactgaatgtggataaaggcaccaaaaagtggaatgaataaagtcacgtacatcggactgtgaagaaaaatcatgttttggaaaagctgtccacacaatacaagaatttttaatcgaagaaaaattcactggcaaagaagccactactgcctctaaaataagaccacaaggcaaacacccagagacatttgagcctccaactaggaaactagcagaagctctaccactgcccacagcaaagattcaaaattgggcaacctgtggacttggcatctgactggtgcggcaaggaaggaggctggtaggtaagcgctactgtgcccaaccccgagctgcctcttcgcagtcttcaggagcaagtcccccattccagctcctctggcagagtatggagttacctgcgtccggggcaggaaaccatgaatgtgcccttctgccctcttgcctttctgccactctttgagttcccgtccttaattgaagagccagtgactattggctgaagttcccccagcgatttgcatgaaccgagagggagtgtcttctgccgccctcccttcaagagcgctctgactgcagcctcccagggaatgcgcggccgagggaatgcgcgcagctcacaggccctgggagtgagctggtgcccggcgacctggcacccgcgcctggatatggggcgtctacatcgtcccaggagcagcaccagctacaggaacctgccgcatctgtttctgtttttcctcttcgtgggacccttcagctgcctcgggagttacagccgggccaccgagcttctgtacagcctaaacgagggactacccgcgggggtgctcatcggcagcctggccgaggacctgcggctgctgcccaggtctgcagggaggccggacccgcagtcgcagctgccagagcgcaccggtgctgagtggaacccccctctctccttcagcctggcctcccggggactgagtggccagtacgtgaccctagacaaccgctctggggagctgcacacttcagctcaggagatcgacagggaggccctgtgtgttgaagggggtggagggactgcgtggagcggcagcgtttccatctcctcctctccttctgactcttgtcttttgctgctggatgtgcttgtcctgcctcaggaatacttcaggtttgtgaaggtgaagatcgccatcagagacatcaatgacaacgccccgcagttccctgtttcccagatctcggtgtgggtcccggaaaatgcacctgtaaacacccgactggccatagagcatcctgctgtggacccagatgtaggcattaatggggtacagacctatcgcttactggactaccatggtatgttcaccctggacgtggaggagaatgagaatggggagcgcaccccctacctaattgtcatgggtgctttggacagggaaacccaggaccagtatgtgagcatcatcatagctgaggatggtgggtctccaccacttttgggcagtgccactctcaccattggcatcagtgacattaatgacaattgccctctcttcacagactcacaaatcaatgtcactgtgtatgggaatgctacagtgggcaccccaattgcagctgtccaggctgtggataaagacttggggaccaatgctcaaattacttattcttacagtcagaaagttccacaagcatctaaggatttatttcacctggatgaaaacactggagtcattaaacttttcagtaagattggaggaagtgttctggagtcccacaagctcaccatccttgctaatggaccaggctgcatccctgctgtaatcactgctcttgtgtccattattaaagttattttcagaccccctgaaattgtccctcgttacatagcaaacgagatagatggtgtggtttatctgaaagaactggaacccgttaacactcccattgcgtttttcaccataagagatccagaaggtaaatacaaggttaactgctacctggatggtgaagggccgtttaggttatcaccttacaaaccatacaataatgaatatttactagagaccacaaaacctatggactatgagctacagcagttctatgaagtagctgtggtggcttggaactctgagggatttcatgtcaaaagggtcattaaagtgcaacttttagatgacaatgataatgctccaattttccttcaacccttaatagaactaaccatcgaagagaacaactcacccaatgcctttttgactaagctgtatgctacagatgccgacagcgaggagagaggccaagtttcatattttctgggacctgatgctccatcatatttttccttagacagtgtcacaggaattctgacagtttctactcagctggaccgagaagagaaagaaaagtacagatacactgtcagagctgttgactgtgggaagccacccagagaatcagtagccactgtggccctcacagtgttggataaaaatgacaacagtcctcggtttatcaacaaggacttcagcttttttgtgcctgaaaactttccaggctatggtgagattggagtaattagtgtaacagatgctgacgctggacgaaatggatgggtcgccctctctgtggtgaaccagagtgatatttttgtcatagatacaggaaagggtatgctgagggctaaagtctctttggacagagagcagcaaagctcctatactttgtgggttgaagctgttgatgggggtgagcctgccctctcctctacagcaaaaatcacaattctccttctagatatcaatgacaaccctcctcttgttttgtttcctcagtctaatatgtcttatctgttagtactgccttctactctgccaggctccccggttacagaagtctatgctgtcgacaaagacacaggcatgaatgctgtcatagcttacagcatcatagggagaagaggtcctaggcctgagtccttcaggattgaccctaaaactggcaacattactttggaagaggcattgctgcagacagattatgggctccatcgcttactggtgaaagtgagtgatcatggttatcccgagcctctccactccacagtcatggtgaacctatttgtcaatgacactgtcagtaatgagagttacattgagagtcttttaagaaaagaaccagagattaatatagaggagaaagaaccacaaatctcaatagaaccgactcataggaaggtagaatctgtgtcttgtatgcccaccttagtagctctgtctgtaataagcttgggttccatcacactggtcacagggatgggcatatacatctgtttaaggaaaggggaaaagcatcccagggaagatgaaaatttggaagtacagattccactgaaaggaaaaattgacttgcatatgcgagagagaaagccaatggatatttctaatatttgatatttcatggtggaataacacagagaaatgttttaactgactttggatcttcatcacctaaaaaagagtgtgttgatggcagttccaatgaaggacaactaatttataacttgttctatattgtaaatagctgtttacaggtttttaaatttaaattcagaggttataaaatgtgtacagcatttttaagtgaaaattagtactaacagctataggacttgtatttaaaaaaaaaaaaaaagcttggacatggtttgcagctttcatacaccaagcagatgattgataaaacctgggagtaaggtaagaaaaatggaacaaatttttatctaaaaattcctgtcaccacaagagggcatcagctgctcctttgcaggaaactggggtattgtacttggcagttgtacatgaaattaatgaaagagtatattttaaatatattgtttttaacattaaacaaatatgaaattaaagtaaattaaatttcaccctatttaaacatatgataaaaaaagaaatgcacttgtaaacagaatgtttattacctcataagtgcatatatagtgtgaaagagaaggcattaaaaagaagtgcaattcctttttagcaaggataaaatcattgccttgtgttacagattcagcctgctgaagagtattccactttctgtgtactcgaattgctttctgtttgctttaccactgcacttgttattattacaagggaaatagatttatacatacatatatatattcttcattacaggaaatgtaactagatattgtgcccaagaaaaacagccagaagcaaagaaatgcttcaatctttagttgcttcataggcattcatgacattttagtgctttcacaacttgttggtcgtactttatacttgggttatatattagacttttataggcttgaaatcatccatcacataagaaaatagaaatcatattaaaagtgaattcttctagaggcttgtgtacactactggttgttttagttgggccttttatatgaaagttatactgtacttatctttttgttgttgtttaggtttgttgactaccatttctggcttcctttctttggttttggattaaatccaacagtttatttgtaagccctgcagcagatttctttgataatttagcttttactgaatctcttgcaatgaagaaagctatttcatcagtgatttatcactttcaattcattgtgtgagctggaaatattattttatatgagagctatagcaaaataatctgtataaacaaggaatgtgttagcttaaactggatcattttactttttggcatcatgcatctgtactgtaccaaaagtgtttatatgtctgcaaattaaaggtatatattttcataa

SEQ ID NO: 24830 - DNA, 4605 bp, Homo sapiens
tttattttaattctccctctcttgctagcaacctgtggacttggcatctgactggtgcggcaaggaaggaggctggtaggtaagcgctactgtgcccaaccccgagctgcctcttcgcagtcttcaggagcaagtcccccattccagctcctctggcagagtatggagttacctgcgtccggggcaggaaaccatgaatgtgcccttctgccctcttgcctttctgccactctttgagttcccgtccttaattgaagagccagtgactattggctgaagttcccccagcgatttgcatgaaccgagagggagtgtcttctgccgccctcccttcaagagcgctctgactgcagcctcccagggaatgcgcggccgagggaatgcgcgcagctcacaggccctgggagtgagctggtgcccggcgacctggcacccgcgcctggatatggggcgtctacatcgtcccaggagcagcaccagctacaggaacctgccgcatctgtttctgtttttcctcttcgtgggacccttcagctgcctcgggagttacagccgggccaccgagcttctgtacagcctaaacgagggactacccgcgggggtgctcatcggcagcctggccgaggacctgcggctgctgcccaggtctgcagggaggccggacccgcagtcgcagctgccagagcgcaccggtgctgagtggaacccccctctctccttcagcctggcctcccggggactgagtggccagtacgtgaccctagacaaccgctctggggagctgcacacttcagctcaggagatcgacagggaggccctgtgtgttgaagggggtggagggactgcgtggagcggcagcgtttccatctcctcctctccttctgactcttgtcttttgctgctggatgtgcttgtcctgcctcaggaatacttcaggtttgtgaaggtgaagatcgccatcagagacatcaatgacaacgccccgcagttccctgtttcccagatctcggtgtgggtcccggaaaatgcacctgtaaacacccgactggccatagagcatcctgctgtggacccagatgtaggcattaatggggtacagacctatcgcttactggactaccatggtatgttcaccctggacgtggaggagaatgagaatggggagcgcaccccctacctaattgtcatgggtgctttggacagggaaacccaggaccagtatgtgagcatcatcatagctgaggatggtgggtctccaccacttttgggcagtgccactctcaccattggcatcagtgacattaatgacaattgccctctcttcacagactcacaaatcaatgtcactgtgtatgggaatgctacagtgggcaccccaattgcagctgtccaggctgtggataaagacttggggaccaatgctcaaattacttattcttacagtcagaaagttccacaagcatctaaggatttatttcacctggatgaaaacactggagtcattaaacttttcagtaagattggaggaagtgttctggagtcccacaagctcaccatccttgctaatggaccaggctgcatccctgctgtaatcactgctcttgtgtccattattaaagttattttcagaccccctgaaattgtccctcgttacatagcaaacgagatagatggtgtggtttatctgaaagaactggaacccgttaacactcccattgcgtttttcaccataagagatccagaaggtaaatacaaggttaactgctacctggatggtgaagggccgtttaggttatcaccttacaaaccatacaataatgaatatttactagagaccacaaaacctatggactatgagctacagcagttctatgaagtagctgtggtggcttggaactctgagggatttcatgtcaaaagggtcattaaagtgcaacttttagatgacaatgataatgctccaattttccttcaacccttaatagaactaaccatcgaagagaacaactcacccaatgcctttttgactaagctgtatgctacagatgccgacagcgaggagagaggccaagtttcatattttctgggacctgatgctccatcatatttttccttagacagtgtcacaggaattctgacagtttctactcagctggaccgagaagagaaagaaaagtacagatacactgtcagagctgttgactgtgggaagccacccagagaatcagtagccactgtggccctcacagtgttggataaaaatgacaacagtcctcggtttatcaacaaggacttcagcttttttgtgcctgaaaactttccaggctatggtgagattggagtaattagtgtaacagatgctgacgctggacgaaatggatgggtcgccctctctgtggtgaaccagagtgatatttttgtcatagatacaggaaagggtatgctgagggctaaagtctctttggacagagagcagcaaagctcctatactttgtgggttgaagctgttgatgggggtgagcctgccctctcctctacagcaaaaatcacaattctccttctagatatcaatgacaaccctcctcttgttttgtttcctcagtctaatatgtcttatctgttagtactgccttctactctgccaggctccccggttacagaagtctatgctgtcgacaaagacacaggcatgaatgctgtcatagcttacagcatcatagggagaagaggtcctaggcctgagtccttcaggattgaccctaaaactggcaacattactttggaagaggcattgctgcagacagattatgggctccatcgcttactggtgaaagtgagtgatcatggttatcccgagcctctccactccacagtcatggtgaacctatttgtcaatgacactgtcagtaatgagagttacattgagagtcttttaagaaaagaaccagagattaatatagaggagaaagaaccacaaatctcaatagaaccgactcataggaaggtagaatctgtgtcttgtatgcccaccttagtagctctgtctgtaataagcttgggttccatcacactggtcacagggatgggcatatacatctgtttaaggaaaggggaaaagcatcccagggaagatgaaaatttggaagtacagattccactgaaaggaaaaattgacttgcatatgcgagagagaaagccaatggatatttctaatatttgatatttcatggtggaataacacagagaaatgttttaactgactttggatcttcatcacctaaaaaagagtgtgttgatggcagttccaatgaaggacaactaatttataacttgttctatattgtaaatagctgtttacaggtttttaaatttaaattcagaggttataaaatgtgtacagcatttttaagtgaaaattagtactaacagctataggacttgtatttaaaaaaaaaaaaaaagcttggacatggtttgcagctttcatacaccaagcagatgattgataaaacctgggagtaaggtaagaaaaatggaacaaatttttatctaaaaattcctgtcaccacaagagggcatcagctgctcctttgcaggaaactggggtattgtacttggcagttgtacatgaaattaatgaaagagtatattttaaatatattgtttttaacattaaacaaatatgaaattaaagtaaattaaatttcaccctatttaaacatatgataaaaaaagaaatgcacttgtaaacagaatgtttattacctcataagtgcatatatagtgtgaaagagaaggcattaaaaagaagtgcaattcctttttagcaaggataaaatcattgccttgtgttacagattcagcctgctgaagagtattccactttctgtgtactcgaattgctttctgtttgctttaccactgcacttgttattattacaagggaaatagatttatacatacatatatatattcttcattacaggaaatgtaactagatattgtgcccaagaaaaacagccagaagcaaagaaatgcttcaatctttagttgcttcataggcattcatgacattttagtgctttcacaacttgttggtcgtactttatacttgggttatatattagacttttataggcttgaaatcatccatcacataagaaaatagaaatcatattaaaagtgaattcttctagaggcttgtgtacactactggttgttttagttgggccttttatatgaaagttatactgtacttatctttttgttgttgtttaggtttgttgactaccatttctggcttcctttctttggttttggattaaatccaacagtttatttgtaagccctgcagcagatttctttgataatttagcttttactgaatctcttgcaatgaagaaagctatttcatcagtgatttatcactttcaattcattgtgtgagctggaaatattattttatatgagagctatagcaaaataatctgtataaacaaggaatgtgttagcttaaactggatcattttactttttggcatcatgcatctgtactgtaccaaaagtgtttatatgtctgcaaattaaaggtatatattttcataa

SEQ ID NO: 24831 - DNA, 3603 bp, Homo sapiens
atgctgaggatgcggaccgcgggatgggcgcgcggctggtgcttgggctgctgcctcctcctgccgctctcgctcagcctggcggccgccaagcagctcctccggtaccggctggccgaggagggccccgccgacgtccgcatcggcaacgtggcttcagacctgggcatcgtgaccggatcgggtgaggtgactttcagcctggagtccggttccgagtacctgaagatcgacaacctcactggcgagctgagcacgagcgagcggcgcatcgaccgcgagaagctgccccagtgtcagatgatcttcgacgagaacgagtgcttcctggacttcgaggtgtcggtgatcgggccctcgcagagctgggtggacctgtttgagggtcaggtcatcgtgcttgacatcaacgacaacacgcccaccttcccgtcgcccgtgctcacgctcacggtggaggagaatcggccggtgggcacactttacctgctgcccacagccaccgaccgcgacttcggccgcaacggcatcgagcgctacgagctgctccaggagcccggaggcggcggcagcggcggcgagagccggcgcgccggggcggccgacagcgccccctaccccgggggcggcgggaacggcgcgagcggcggcggctcgggaggctccaagcggcggctggacgcatcagagggcggcggcggcaccaaccccggcggccgcagcagcgtgttcgagctgcaggtggcggacaccccggacggcgagaagcagccgcagctgatcgtgaagggcgtgtacgaggccgacttggctgagaacagcgccccggggacccccatcctgcaactgcgcgcagccgacttggacgtgggggtcaacgggcagatcgaatacgtgttcggggcggccaccgagtcggtgaggcggctgctgcgccttgacgagacgtccggctggctcagcgtcctgcaccggatcgaccgcgaggaggtgaaccagctgcgcttcacggtcatggcccgcgaccgcgggcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacccgggagttcaacgtggtcatcgtggcggtggactcaggcagccccagcctctcgagcaacaactccctgattgtcaaggtgggagacaccaacgacaacccgcccatgttcggccagtcggtggtggaggtttacttccctgagaacaacatcccgggcgagagggtggccacggtgctggcgacagacgcagacagcggtaagaacgccgagatcgcctactcgctggactcctctgtgatggggatctttgccatcgatcccgattctggggacatcctggtcaataccgtgctggaccgcgagcagactgacaggtatgagtttaaagttaacgccaaagacaaaggcatccccgtgctgcagggcagcactacggtgattgtgcaggtggctgataaaaatgacaatgaccctaagtttatgcaggacgtcttcaccttttatgtgaaagaaaacttgcagcccaacagccctgtggggatggtcaccgtgatggatgctgacaaggggcggaatgcagagatgagcctgtacatagaggagaacaataacattttttctattgaaaatgacacggggaccatttactccacaatgtcttttgaccgggaacatcagaccacatacactttcagagtcaaggctgtggatgggggagatcctcccagatctgccacagctacagtctcgctttttgtgatggatgaaaatgacaatgctcccacagttacccttcccaaaaacatttcctacactttactgccaccttcgagtaatgtcaggacagtagtagctacagtgttggcaacagacagtgatgatggcatcaatgcagacctgaactacagcattgtgggaggaaatcccttcaagctgtttgaaattgatcccactagtggtgtggtttccttagtgggaaaactcacccaaaagcattatggcttgcacaggttggtggtgcaagtgaatgacagtgggcagccttcccagtccaccacgactctggtgcacgtgtttgtcaatgaaagtgtttctaatgcaactgcgattgactcccagatagctagaagtttgcacatcccactcacccaggatatagctggtgacccaagctatgaaattagcaaacagagactcagtattgtcattggcgtggttgctggcattatgacggtgattctaatcatcttaattgtagtgatggcaaggtactgcaggtccaaaaataaaaatggctatgaagccggcaaaaaagatcacgaagacttttttacaccccaacagcatgacaaatctaaaaagcctaaaaaggacaagaaaaacaaaaaatctaagcagcctctctacagcagcattgtcactgtggaggcttctaagccaaatggacagaggtatgatagtgtcaatgagaagctgtcagacagcccaagcatggggcgatacaggtccgttaatggtgggcccggcagtcctgacctggcaaggcattacaaatctagttccccattgcctactgttcagcttcatccccagtcaccaactgcaggaaaaaaacaccaggccgtacaagatctaccaccagccaacacatttgtgggagcaggagacaacatttcaattggatcagatcactgctctgagtacagctgtcaaaccaataacaagtacagcaaacagccatttcgtagagtgacgttttctgttgtgagtcagcctcaggacccacatcaggggtcactgcagagttgctatgacagcgggctggaggagtcagaaacaccaagcagtaagagttcatcagggccaagactgggtgcgcttccactcccagaggacaactatgaaaggaccacgccggatggcagtgttgattcaaggcctcttccagatgtagccctgactgggaagtgcactcgtgagtgtgatgagtatggccactcagactcctgctggatgccggtccgcacttctccggagaggaagaagagccagcctaaactgtccactttcatgcctgttgatgaacgaggaagccaggaaaagctggccaatggggaggccgccatcatgggtgaccgcaacagaaacctcctgaacaaaaagttgacctcatcctatgagaccttcagtgcagctagtttcagcaaaaatgaggaagccaaccctgaggatattccccttacaaaaacaggggaatataagccatctcctgtcaatactctcactagaagagaagtttacctgtag

SEQ ID NO: 24832 - DNA, 5398 bp, Homo sapiens
gaatgcaggtgagaaaaggcacggactctgcggctgcgaacccaaacttgggcaccgcacggtgcgcactgctcagccttcgcccccgtgggcgaaaggctgctgcggtttcaggcggctgcttcgtgactaatgaccttgcgcagagttgttaagaaaaaagagaaacccgcgctctccggggtgagaagggactgactctgggcgtctctgaagatggctcgggcttctctttggcgcgccggggggaccctgacactgaccgctctgtgacgcgagtagtctcccctgcaccgtgcccgaagcgacgtgccgggggatttttcattctcgatctgttgactggctcccccgctgcatgagcagagtcggagttgagactggcttgttgctggccccagcgcctggtgcaggaagcgactcacgtttgtctgggtggccggagccggagcagagcctgggtttggagtgagtgcctggaacgtgaattggactcaactcgagtagcagcaaagaccagcgggctggcaggcgggggaggctgcaggctcattccccacctcttcccagccccactgcccgtctgccggagcggttctggccccttccgacagagcggggactagagccggggattctccgcccgctgaggggatgactctgggttgggggagcgccgaacccgcggcgcgcagtgtcccgtgaactgtgagtactgcgactgaacggcggcaggcgagcgggcgattagcacccattgcatgaattatgaaacaataactttcggaagaagcaggaggaaaaaaagaagcatctatcgctgccctcccacccccattcccggccaactctccacgccgcttttgccccctccctcccctccctctcgctccttcctttccgggagaggggagaggactcgggggagggcaggcggccggccccggaggaggggggcgccgagggggctgtggttagaaggagcagtagcagcagcagcaggagaagatgctgaggatgcggaccgcgggatgggcgcgcggctggtgcttgggctgctgcctcctcctgccgctctcgctcagcctggcggccgccaagcagctcctccggtaccggctggccgaggagggccccgccgacgtccgcatcggcaacgtggcttcagacctgggcatcgtgaccggatcgggtgaggtgactttcagcctggagtccggttccgagtacctgaagatcgacaacctcactggcgagctgagcacgagcgagcggcgcatcgaccgcgagaagctgccccagtgtcagatgatcttcgacgagaacgagtgcttcctggacttcgaggtgtcggtgatcgggccctcgcagagctgggtggacctgtttgagggtcaggtcatcgtgcttgacatcaacgacaacacgcccaccttcccgtcgcccgtgctcacgctcacggtggaggagaatcggccggtgggcacactttacctgctgcccacagccaccgaccgcgacttcggccgcaacggcatcgagcgctacgagctgctccaggagcccggaggcggcggcagcggcggcgagagccggcgcgccggggcggccgacagcgccccctaccccgggggcggcgggaacggcgcgagcggcggcggctcgggaggctccaagcggcggctggacgcatcagagggcggcggcggcaccaaccccggcggccgcagcagcgtgttcgagctgcaggtggcggacaccccggacggcgagaagcagccgcagctgatcgtgaagggggcgctggaccgcgagcagcgcgactcctacgagctgaccctgcgagtgcgcgacggcggcgacccgcctcgctcctcgcaggccatcctacgggtcctcatcaccgacgtgaacgacaacagcccccgcttcgagaagagcgtgtacgaggccgacttggctgagaacagcgccccggggacccccatcctgcaactgcgcgcagccgacttggacgtgggggtcaacgggcagatcgaatacgtgttcggggcggccaccgagtcggtgaggcggctgctgcgccttgacgagacgtccggctggctcagcgtcctgcaccggatcgaccgcgaggaggtgaaccagctgcgcttcacggtcatggcccgcgaccgcgggcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacccgggagttcaacgtggtcatcgtggcggtggactcaggcagccccagcctctcgagcaacaactccctgattgtcaaggtgggagacaccaacgacaacccgcccatgttcggccagtcggtggtggaggtttacttccctgagaacaacatcccgggcgagagggtggccacggtgctggcgacagacgcagacagcggtaagaacgccgagatcgcctactcgctggactcctctgtgatggggatctttgccatcgatcccgattctggggacatcctggtcaataccgtgctggaccgcgagcagactgacaggtatgagtttaaagttaacgccaaagacaaaggcatccccgtgctgcagggcagcactacggtgattgtgcaggtggctgataaaaatgacaatgaccctaagtttatgcaggacgtcttcaccttttatgtgaaagaaaacttgcagcccaacagccctgtggggatggtcaccgtgatggatgctgacaaggggcggaatgcagagatgagcctgtacatagaggagaacaataacattttttctattgaaaatgacacggggaccatttactccacaatgtcttttgaccgggaacatcagaccacatacactttcagagtcaaggctgtggatgggggagatcctcccagatctgccacagctacagtctcgctttttgtgatggatgaaaatgacaatgctcccacagttacccttcccaaaaacatttcctacactttactgccaccttcgagtaatgtcaggacagtagtagctacagtgttggcaacagacagtgatgatggcatcaatgcagacctgaactacagcattgtgggaggaaatcccttcaagctgtttgaaattgatcccactagtggtgtggtttccttagtgggaaaactcacccaaaagcattatggcttgcacaggttggtggtgcaagtgaatgacagtgggcagccttcccagtccaccacgactctggtgcacgtgtttgtcaatgaaagtgtttctaatgcaactgcgattgactcccagatagctagaagtttgcacatcccactcacccaggatatagctggtgacccaagctatgaaattagcaaacagagactcagtattgtcattggcgtggttgctggcattatgacggtgattctaatcatcttaattgtagtgatggcaaggtactgcaggtccaaaaataaaaatggctatgaagccggcaaaaaagatcacgaagacttttttacaccccaacagcatgacaaatctaaaaagcctaaaaaggacaagaaaaacaaaaaatctaagcagcctctctacagcagcattgtcactgtggaggcttctaagccaaatggacagaggtatgatagtgtcaatgagaagctgtcagacagcccaagcatggggcgatacaggtccgttaatggtgggcccggcagtcctgacctggcaaggcattacaaatctagttccccattgcctactgttcagcttcatccccagtcaccaactgcaggaaaaaaacaccaggccgtacaagatctaccaccagccaacacatttgtgggagcaggagacaacatttcaattggatcagatcactgctctgagtacagctgtcaaaccaataacaagtacagcaaacagatgcgtctacatccatacattactgtgtttggctgaattccactctaatatgatgctccattatgcaccatactgtgatgacctttctactccgaaacctgctggagcctgcccttggccgtggggtgtcagccaatcactgcttgttccacttgttgtacattttatttttgagtctttttctttctcatatacagaaaaatagtatgaaaataaaataaatgtatgaaacagtattaatgcagaaatgtgctactaatggatgtctgagtcaccagaaattccattcttaaagaggcggttagcacctattagacgtaacagtgatgtcttttaaaaaatccaaaagcatattgcaacaataagtttgagactttgtgtgaacaaagggaaattcagcctcttatgtctttgtctttaatacattaaatactgattttgaataaaaatctaaattgatcaatatttttaagtgccatgtaatcacaggcctgtcagatagttttgttagagtgaaggataatatcttttgctcattctgtgtgtgtatttttaaatgctgttttgtgtgtttgtgtgtgtttccatatatgtgtgtgtgtgtgtgtgtatatatatatatatgctggaactttgagcaatatttataaaaatattgtctgtaaaacaagtttgagaaattaattttttatatttataatgggcactgtaatggattgatttttttcttaatcttgaaatagtgaccaagatatttatatcatttttgaatttattttttaattctttaagaaaatttagaacttttcactttcatttgctaaagtcactgtagtcacattcggaaggaatatgtggctttctgttctttatggactacgtttatcagaagtccatatttattaaacatcctatttgatgtcagataacgtaaactcaagcagcttcaaagagttcagcatgttacatattattgagagagcaagtgactgaattttagttgtataagcaatattataggtaggtcagggagtcctctggatggcccctctacctctttatgtttgtatgtttatgtctttatttgttatgtcgtatgtgtttatgagcctagaaaatagcctagaaaataagtgttccatatgtaaagtttaataattttgtaatacatttaccacgctgtctgccctattaaaattttccacaaatttgggaa

SEQ ID NO: 24833 - DNA, 3768 bp, Homo sapiens
atgctgaggatgcggaccgcgggatgggcgcgcggctggtgcttgggctgctgcctcctcctgccgctctcgctcagcctggcggccgccaagcagctcctccggtaccggctggccgaggagggccccgccgacgtccgcatcggcaacgtggcttcagacctgggcatcgtgaccggatcgggtgaggtgactttcagcctggagtccggttccgagtacctgaagatcgacaacctcactggcgagctgagcacgagcgagcggcgcatcgaccgcgagaagctgccccagtgtcagatgatcttcgacgagaacgagtgcttcctggacttcgaggtgtcggtgatcgggccctcgcagagctgggtggacctgtttgagggtcaggtcatcgtgcttgacatcaacgacaacacgcccaccttcccgtcgcccgtgctcacgctcacggtggaggagaatcggccggtgggcacactttacctgctgcccacagccaccgaccgcgacttcggccgcaacggcatcgagcgctacgagctgctccaggagcccggaggcggcggcagcggcggcgagagccggcgcgccggggcggccgacagcgccccctaccccgggggcggcgggaacggcgcgagcggcggcggctcgggaggctccaagcggcggctggacgcatcagagggcggcggcggcaccaaccccggcggccgcagcagcgtgttcgagctgcaggtggcggacaccccggacggcgagaagcagccgcagctgatcgtgaagggggcgctggaccgcgagcagcgcgactcctacgagctgaccctgcgagtgcgcgacggcggcgacccgcctcgctcctcgcaggccatcctacgggtcctcatcaccgacgtgaacgacaacagcccccgcttcgagaagagcgtgtacgaggccgacttggctgagaacagcgccccggggacccccatcctgcaactgcgcgcagccgacttggacgtgggggtcaacgggcagatcgaatacgtgttcggggcggccaccgagtcggtgaggcggctgctgcgccttgacgagacgtccggctggctcagcgtcctgcaccggatcgaccgcgaggaggtgaaccagctgcgcttcacggtcatggcccgcgaccgcgggcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacccgggagttcaacgtggtcatcgtggcggtggactcaggcagccccagcctctcgagcaacaactccctgattgtcaaggtgggagacaccaacgacaacccgcccatgttcggccagtcggtggtggaggtttacttccctgagaacaacatcccgggcgagagggtggccacggtgctggcgacagacgcagacagcggtaagaacgccgagatcgcctactcgctggactcctctgtgatggggatctttgccatcgatcccgattctggggacatcctggtcaataccgtgctggaccgcgagcagactgacaggtatgagtttaaagttaacgccaaagacaaaggcatccccgtgctgcagggcagcactacggtgattgtgcaggtggctgataaaaatgacaatgaccctaagtttatgcaggacgtcttcaccttttatgtgaaagaaaacttgcagcccaacagccctgtggggatggtcaccgtgatggatgctgacaaggggcggaatgcagagatgagcctgtacatagaggagaacaataacattttttctattgaaaatgacacggggaccatttactccacaatgtcttttgaccgggaacatcagaccacatacactttcagagtcaaggctgtggatgggggagatcctcccagatctgccacagctacagtctcgctttttgtgatggatgaaaatgacaatgctcccacagttacccttcccaaaaacatttcctacactttactgccaccttcgagtaatgtcaggacagtagtagctacagtgttggcaacagacagtgatgatggcatcaatgcagacctgaactacagcattgtgggaggaaatcccttcaagctgtttgaaattgatcccactagtggtgtggtttccttagtgggaaaactcacccaaaagcattatggcttgcacaggttggtggtgcaagtgaatgacagtgggcagccttcccagtccaccacgactctggtgcacgtgtttgtcaatgaaagtgtttctaatgcaactgcgattgactcccagatagctagaagtttgcacatcccactcacccaggatatagctggtgacccaagctatgaaattagcaaacagagactcagtattgtcattggcgtggttgctggcattatgacggtgattctaatcatcttaattgtagtgatggcaaggtactgcaggtccaaaaataaaaatggctatgaagccggcaaaaaagatcacgaagacttttttacaccccaacagcatgacaaatctaaaaagcctaaaaaggacaagaaaaacaaaaaatctaagcagcctctctacagcagcattgtcactgtggaggcttctaagccaaatggacagaggtatgatagtgtcaatgagaagctgtcagacagcccaagcatggggcgatacaggtccgttaatggtgggcccggcagtcctgacctggcaaggcattacaaatctagttccccattgcctactgttcagcttcatccccagtcaccaactgcaggaaaaaaacaccaggccgtacaagatctaccaccagccaacacatttgtgggagcaggagacaacatttcaattggatcagatcactgctctgagtacagctgtcaaaccaataacaagtacagcaaacagccatttcgtagagtgacgttttctgttgtgagtcagcctcaggacccacatcaggggtcactgcagagttgctatgacagcgggctggaggagtcagaaacaccaagcagtaagagttcatcagggccaagactgggtgcgcttccactcccagaggacaactatgaaaggaccacgccggatggcagtgttggtgaggcagagcatatggaaaatgattcaaggcctcttccagatgtagccctgactgggaagtgcactcgtgagtgtgatgagtatggccactcagactcctgctggatgccggtccgcacttctccggagaggaagaagagccagcctaaactgtccactttcatgcctgttgatgaacgaggaagccaggaaaagctggccaatggggaggccgccatcatgggtgaccgcaacagaaacctcctgaacaaaaagttgacctcatcctatgagaccttcagtgcagctagtttcagcaaaaatgaggaagccaaccctgaggatattccccttacaaaaacaggggaatataagccatctcctgtcaatactctcactagaagagaagtttacctgtag

SEQ ID NO: 24834 - DNA, 3570 bp, Homo sapiens
gactgacgcccgacctggaaaccagagaagacttccttagcctttcggatcgcacttgaggctggaggcatgagtcctgtgaggcgttggggcagcccctgccttttccccttgcagctcttcagcctctgctgggtgctctcagtggcccagagcaaaacagtccgatacagcaccttcgaggaggatgcccccggcacggtcatcgggaccctggccgaggacctgcatatgaaagtatcgggtgacacaagcttccgcctgatgaagcaattcaacagctctctgctccgggtgcgcgaaggcgacgggcagctgaccgtcggggacgccggcctggaccgcgagcggctgtgtggccaggccccgcagtgcgtgctggccttcgatgtggtcagcttctcgcaggagcagttccggctggtgcacgtggaggtagaggtgagggacgtcaacgaccacgcgccgcgcttccccagggcccagatcccggtagaggtgtccgagggtgcggcagtgggcacgcgcatccccttggaggtgccggtggacgaggacgtgggcgccaacgggctgcagaccgtgcgcctggccgagccgcacagcccctttcgcgtggagctgcagacgcgagcggacggcgctcagtgcgcagacctggtgctgctgcaggagctggaccgcgagagccaggccgcctacagcctggagctggtggcccaggacggcggccgcccgccgcgctccgccacggctgccctcagcgtgcgcgtcctggatgcgaatgaccacagcccggccttcccgcagggcgccgtggccgaagtggagctggcggaagacgcgcccgtgggctccctgcttctcgacctggacgcagccgaccccgacgagggacctaacggcgacgtggtgttcgcatttggcgcccgcaccccgccggaggcgcgccgcctctttcggcttgacccgcgatcaggccgcctcaccctggccgggcccgtggactacgagcgtcaggacacctacgagctggacgtgcgggcgcaggaccgcggacccgggccccgcgctgccacctgcaaggtcatcgtgcgcatccgagacgtcaatgacaacgcacccgacatcgccatcaccccgctggccgccccaggcgcgccggcaacctcacccttcgccgctgccgccgccgccgctgcactcgggggagcggacgctagctcgccggcgggagccgggacgccggaggctggtgccacttcgctggtgccggagggggcggcgcgcgagagcctggtggccctggtcagcacctcggacagggactcgggcgccaacgggcaagtgcgctgcgccctctatgggcacgagcacttccggctgcagccggcctacgcgggcagctacctggtggtgaccgcggcgtcgctggaccgcgaacgcatcgccgagtacaacttgacgctggtggccgaggatcgcggcgcgcccccgctgcgcacagtgcggccctacacggtgcgtgtgggcgacgagaacgacaacgcgccgctcttcacgcggccggtctatgaggtgtcggtgcgcgagaacaacccgccaggcgcctacctggccacggtggccgcccgcgaccgggacctgggccgcaacggccaggtcacctaccggctgctggaggccgaggtgggccgcgccgggggcgccgtgtccacttatgtctcggtggacccagctaccggagccatctacgcgctgcgcagcttcgactatgagacgctgcgccaactcgacgttcgcatccaagctagcgacggcggctcccctcagctttccagcagcgccctagtgcaagtgcgcgtgctggaccagaacgaccatgcgccagtcctggtgcacccggcgccagccaatggctccctagaagtggcggtgcctgggcgcaccgcaaaggacacggttgtggcccgtgtgcaggcccgggatgcagacgagggagccaacggggagctggcgttcgagctgcagcagcaggagccgcgcgaagccttcgccatcggccgccgcacgggggagatactgctcaccggcgacctctcgcaggagccacccggtcgcgtgttcagggcgctcctggtcatatccgacggcggccgtcccccgctcaccaccaccgcaactgtcagcttcgtggtaacagcagggggcgggcgtgggccggctgcgcctgccagtgcaggaagcccggagcgttcccgcccgcctggctctcggctcggggtgtccgggtcggtgctgcaatgggacacgccgctgatcgtcatcatcgtgctggccgggagctgcacgctgctgctggccgccatcatcgccatcgccaccacctgcaaccgccgcaagaaggagccctacggtgcctccccgggttttggaaaggagccggcgccccctgtggcggtgtggaaaggacactccttcaacaccatttctggcagagaagcagagaagttcagcggcaaagacagcggtaaaggggacagtgatttcaacgacagcgattccgacatcagcggggacgctctgaaaaaggatctcatcaaccacatgcagagtggactgtgggcgtgcaccgctgagtgtaagatcctgggccactctgaccgctgctggagcccatcctgcagcgggcccaacgcacatccatcgcctcacccaccagcccagatgtcaaccttctgtaagagcacgtcactgcctcgggatcctctgcgcagggacaattactaccaggcccagctgcccaagacagtggggctgcagagcgtctatgagaaagtactgcacagagactatgacaggacagtcactctgctctcccctccccgtccagggaggctcccagacctgcaggagattggagtacccctctaccagtcccctcctggcaggtacctgtccccgaagaagggagccaatgaaaatgtgtaatcccatgctgcatgtcttcacacatatacaggtcactccgagaagcccctaagttattgaccggtttcagtgttgtatatataaatatgcaagatgtgccttacaatgaagttgttggaagctatttccaatcacattggtactgtttggtatttgcaaacaaaaatgtagttaatgtaatttttatgaaatgtgtgcagtatttaatttttcttatgctattgactttgatttcaattgcggcttgccattttcttagtgtttttaacctgtacattgtgtaatgtaatgtttgtatataatgaaattttgttatatttttatataataaaagctaaagtggaagttattgccaaaggaactgtctgtaagacaaaaaacaaaacatgttggaattacttaattgaaatttatctttcacctgaaacaacctagtgtttgagaaattttgccttgccaagtataacttgtatatcttgactctgtggtagatttcaagttcaatgttatttaattacatttggttttccgtaaaccgtgtcacttataagcacagtaataaaagatttgtcatgtgtt

SEQ ID NO: 24835 - DNA, 4003 bp, Homo sapiens
agcttctgtaagagacggagaggcgcagagtgagggcgggtccgcgcgtcctcagagcccgctggaggctcggagctgctacccgcagacttctcccgcacagggctcgcaaagagcgtgattccgagagcctgagactgacgcccgacctggaaaccagagaagacttccttagcctttcggatcgcacttgaggctggaggcatgagtcctgtgaggcgttggggcagcccctgccttttccccttgcagctcttcagcctctgctgggtgctctcagtggcccagagcaaaacagtccgatacagcaccttcgaggaggatgcccccggcacggtcatcgggaccctggccgaggacctgcatatgaaagtatcgggtgacacaagcttccgcctgatgaagcaattcaacagctctctgctccgggtgcgcgaaggcgacgggcagctgaccgtcggggacgccggcctggaccgcgagcggctgtgtggccaggccccgcagtgcgtgctggccttcgatgtggtcagcttctcgcaggagcagttccggctggtgcacgtggaggtagaggtgagggacgtcaacgaccacgcgccgcgcttccccagggcccagatcccggtagaggtgtccgagggtgcggcagtgggcacgcgcatccccttggaggtgccggtggacgaggacgtgggcgccaacgggctgcagaccgtgcgcctggccgagccgcacagcccctttcgcgtggagctgcagacgcgagcggacggcgctcagtgcgcagacctggtgctgctgcaggagctggaccgcgagagccaggccgcctacagcctggagctggtggcccaggacggcggccgcccgccgcgctccgccacggctgccctcagcgtgcgcgtcctggatgcgaatgaccacagcccggccttcccgcagggcgccgtggccgaagtggagctggcggaagacgcgcccgtgggctccctgcttctcgacctggacgcagccgaccccgacgagggacctaacggcgacgtggtgttcgcatttggcgcccgcaccccgccggaggcgcgccgcctctttcggcttgacccgcgatcaggccgcctcaccctggccgggcccgtggactacgagcgtcaggacacctacgagctggacgtgcgggcgcaggaccgcggacccgggccccgcgctgccacctgcaaggtcatcgtgcgcatccgagacgtcaatgacaacgcacccgacatcgccatcaccccgctggccgccccaggcgcgccggcaacctcacccttcgccgctgccgccgccgccgctgcactcgggggagcggacgctagctcgccggcgggagccgggacgccggaggctggtgccacttcgctggtgccggagggggcggcgcgcgagagcctggtggccctggtcagcacctcggacagggactcgggcgccaacgggcaagtgcgctgcgccctctatgggcacgagcacttccggctgcagccggcctacgcgggcagctacctggtggtgaccgcggcgtcgctggaccgcgaacgcatcgccgagtacaacttgacgctggtggccgaggatcgcggcgcgcccccgctgcgcacagtgcggccctacacggtgcgtgtgggcgacgagaacgacaacgcgccgctcttcacgcggccggtctatgaggtgtcggtgcgcgagaacaacccgccaggcgcctacctggccacggtggccgcccgcgaccgggacctgggccgcaacggccaggtcacctaccggctgctggaggccgaggtgggccgcgccgggggcgccgtgtccacttatgtctcggtggacccagctaccggagccatctacgcgctgcgcagcttcgactatgagacgctgcgccaactcgacgttcgcatccaagctagcgacggcggctcccctcagctttccagcagcgccctagtgcaagtgcgcgtgctggaccagaacgaccatgcgccagtcctggtgcacccggcgccagccaatggctccctagaagtggcggtgcctgggcgcaccgcaaaggacacggttgtggcccgtgtgcaggcccgggatgcagacgagggagccaacggggagctggcgttcgagctgcagcagcaggagccgcgcgaagccttcgccatcggccgccgcacgggggagatactgctcaccggcgacctctcgcaggagccacccggtcgcgtgttcagggcgctcctggtcatatccgacggcggccgtcccccgctcaccaccaccgcaactgtcagcttcgtggtaacagcagggggcgggcgtgggccggctgcgcctgccagtgcaggaagcccggagcgttcccgcccgcctggctctcggctcggggtgtccgggtcggtgctgcaatgggacacgccgctgatcgtcatcatcgtgctggccgggagctgcacgctgctgctggccgccatcatcgccatcgccaccacctgcaaccgccgcaagaaggaggtgcgcaaagggggggccctccgggaagagcggcccggggcggcgggcggcggagcctcggctcccggctccccggaggaggccgcccggggagccgggcccaggcccaacatgttcgacgtgctcaccttccctggcaccggcaaagcgccctttggcagccccgcggcggacgcgcctccgcctgcggtcgccgcggccgaagtgccgggctcagagggcggcagcgccactggggaaagcgcctgtcacttcgaggggcagcagcggctccgcggcgcgcacgccgagccctacggtgcctccccgggttttggaaaggagccggcgccccctgtggcggtgtggaaaggacactccttcaacaccatttctggcagagaagcagagaagttcagcggcaaagacagcggtaaaggggacagtgatttcaacgacagcgattccgacatcagcggggacgctctgaaaaaggatctcatcaaccacatgcagagtggactgtgggcgtgcaccgctgagtgtaagatcctgggccactctgaccgctgctggagcccatcctgcagcgggcccaacgcacatccatcgcctcacccaccagcccagatgtcaaccttctgtaagagcacgtcactgcctcgggatcctctgcgcagggacaattactaccaggcccagctgcccaagacagtggggctgcagagcgtctatgagaaagtactgcacagagactatgacaggacagtcactctgctctcccctccccgtccagggaggctcccagacctgcaggagattggagtacccctctaccagtcccctcctggcaggtacctgtccccgaagaagggagccaatgaaaatgtgtaatcccatgctgcatgtcttcacacatatacaggtcactccgagaagcccctaagttattgaccggtttcagtgttgtatatataaatatgcaagatgtgccttacaatgaagttgttggaagctatttccaatcacattggtactgtttggtatttgcaaacaaaaatgtagttaatgtaatttttatgaaatgtgtgcagtatttaatttttcttatgctattgactttgatttcaattgcggcttgccattttcttagtgtttttaacctgtacattgtgtaatgtaatgtttgtatataatgaaattttgttatatttttatataataaaagctaaagtggaagttattgccaaaggaactgtctgtaagacaaaaaacaaaacatgttggaattacttaattgaaatttatctttcacctgaaacaacctagtgtttgagaaattttgccttgccaagtataacttgtatatcttgactctgtggtagatttcaagttcaatgttatttaattacatttggttttccgtaaaccgtgtcacttataagcacagtaataaaagatttgtcatgtgtttgaagaa

SEQ ID NO: 24836 - DNA, 2415 bp, Homo sapiens
agcttctgtaagagacggagaggcgcagagtgagggcgggtccgcgcgtcctcagagcccgctggaggctcggagctgctacccgcagacttctcccgcacagggctcgcaaagagcgtgattccgagagcctgagactgacgcccgacctggaaaccagagaagacttccttagcctttcggatcgcacttgaggctggaggcatgagtcctgtgaggcgttggggcagcccctgccttttccccttgcagctcttcagcctctgctgggtgctctcagtggcccagagcaaaacagtccgatacagcaccttcgaggaggatgcccccggcacggtcatcgggaccctggccgaggacctgcatatgaaagtatcgggtgacacaagcttccgcctgatgaagcaattcaacagctctctgctccgggtgcgcgaaggcgacgggcagctgaccgtcggggacgccggcctggaccgcgagcggctgtgtggccaggccccgcagtgcgtgctggccttcgatgtggtcagcttctcgcaggagcagttccggctggtgcacgtggaggtagaggtgagggacgtcaacgaccacgcgccagtcctggtgcacccggcgccagccaatggctccctagaagtggcggtgcctgggcgcaccgcaaaggacacggttgtggcccgtgtgcaggcccgggatgcagacgagggagccaacggggagctggcgttcgagctgcagcagcaggagccgcgcgaagccttcgccatcggccgccgcacgggggagatactgctcaccggcgacctctcgcaggagccacccggtcgcgtgttcagggcgctcctggtcatatccgacggcggccgtcccccgctcaccaccaccgcaactgtcagcttcgtggtaacagcagggggcgggcgtgggccggctgcgcctgccagtgcaggaagcccggagcgttcccgcccgcctggctctcggctcggggtgtccgggtcggtgctgcaatgggacacgccgctgatcgtcatcatcgtgctggccgggagctgcacgctgctgctggccgccatcatcgccatcgccaccacctgcaaccgccgcaagaaggaggtgcgcaaagggggggccctccgggaagagcggcccggggcggcgggcggcggagcctcggctcccggctccccggaggaggccgcccggggagccgggcccaggcccaacatgttcgacgtgctcaccttccctggcaccggcaaagcgccctttggcagccccgcggcggacgcgcctccgcctgcggtcgccgcggccgaagtgccgggctcagagggcggcagcgccactggggaaagcgcctgtcacttcgaggggcagcagcggctccgcggcgcgcacgccgagccctacggtgcctccccgggttttggaaaggagccggcgccccctgtggcggtgtggaaaggacactccttcaacaccatttctggcagagaagcagagaagttcagcggcaaagacagcggtaaaggggacagtgatttcaacgacagcgattccgacatcagcggggacgctctgaaaaaggatctcatcaaccacatgcagagtggactgtgggcgtgcaccgctgagtgtaagatcctgggccactctgaccgctgctggagcccatcctgcagcgggcccaacgcacatccatcgcctcacccaccagcccagatgtcaaccttctgtaagagcacgtcactgcctcgggatcctctgcgcagggacaattactaccaggcccagctgcccaagacagtggggctgcagagcgtctatgagaaagtactgcacagagactatgacaggacagtcactctgctctcccctccccgtccagggaggctcccagacctgcaggagattggagtacccctctaccagtcccctcctggcaggtacctgtccccgaagaagggagccaatgaaaatgtgtaatcccatgctgcatgtcttcacacatatacaggtcactccgagaagcccctaagttattgaccggtttcagtgttgtatatataaatatgcaagatgtgccttacaatgaagttgttggaagctatttccaatcacattggtactgtttggtatttgcaaacaaaaatgtagttaatgtaatttttatgaaatgtgtgcagtatttaatttttcttatgctattgactttgatttcaattgcggcttgccattttcttagtgtttttaacctgtacattgtgtaatgtaatgtttgtatataatgaaattttgttatatttttatataataaaagctaaagtggaagttattgccaaaggaactgtctgtaagacaaaaaacaaaacatgttggaattacttaattgaaatttatctttca

SEQ ID NO: 24837 - DNA, 3103 bp, Homo sapiens
agcttctgtaagagacggagaggcgcagagtgagggcgggtccgcgcgtcctcagagcccgctggaggctcggagctgctacccgcagacttctcccgcacagggctcgcaaagagcgtgattccgagagcctgagactgacgcccgacctggaaaccagagaagacttccttagcctttcggatcgcacttgaggctggaggcatgagtcctgtgaggcgttggggcagcccctgccttttccccttgcagctcttcagcctctgctgggtgctctcagtggcccagagcaaaacagtccgatacagcaccttcgaggaggatgcccccggcacggtcatcgggaccctggccgaggacctgcatatgaaagtatcgggtgacacaagcttccgcctgatgaagcaattcaacagctctctgctccgggtgcgcgaaggcgacgggcagctgaccgtcggggacgccggcctggaccgcgagcggctgtgtggccaggccccgcagtgcgtgctggccttcgatgtggtcagcttctcgcaggagcagttccggctggtgcacgtggaggtagaggtgagggacgtcaacgaccacgcgccgcgcttccccagggcccagatcccggtagaggtgtccgagggtgcggcagtgggcacgcgcatccccttggaggtgccggtggacgaggacgtgggcgccaacgggctgcagaccgtgcgcctggccgagccgcacagcccctttcgcgtggagctgcagacgcgagcggacggcgctcagtgcgcagacctggtgctgctgcaggagctggaccgcgagagccaggccgcctacagcctggagctggtggcccaggacggcggccgcccgccgcgctccgccacggctgccctcagcgtgcgcgtcctggatgcgaatgaccacagcccggccttcccgcagggcgccgtggccgaagtggagctggcggaagacgcgcccgtgggctccctgcttctcgacctggacgcagccgaccccgacgagggacctaacggcgacgtggtgttcgcatttggcgcccgcaccccgccggaggcgcgccgcctctttcggcttgacccgcgatcaggccgcctcaccctggccgggcccgtggactacgagcgtcaggacacctacgagctggacgtgcgggcgcaggaccgcggacccgggccccgcgctgccacctgcaaggtcatcgtgcgcatccgagacgtcaatgacaacgcacccgacatcgccatcaccccgctggccgccccaggcgccggcaacctcacccttcgccgcaacggccaggtcacctaccggctgctggaggccgaggtgggccgcgccgggggcgccgtgtccacttatgtctcggtggacccagctaccggagccatctacgcgctgcgcagcttcgactatgagacgctgcgccaactcgacgttcgcatccaagctagcgacggcggctcccctcagctttccagcagcgccctagtgcaagtgcgcgtgctggaccagaacgaccatgcgccagtcctggtgcacccggcgccagccaatggctccctagaagtggcggtgcctgggcgcaccgcaaaggacacggttgtggcccgtgtgcaggcccgggatgcagacgagggagccaacggggagctggcgttcgagctgcagcagcaggagccgcgcgaagccttcgccatcggccgccgcacgggggagatactgctcaccggcgacctctcgcaggagccacccggtcgcgtgttcagggcgctcctggtcatatccgacggcggccgtcccccgctcaccaccaccgcaactgtcagcttcgtggtaacagcagggggcgggcgtgggccggctgcgcctgccagtgcaggaagcccggagcgttcccgcccgcctggctctcggctcggggtgtccgggtcggtgctgcaatgggacacgccgctgatcgtcatcatcgtgctggccgggagctgcacgctgctgctggccgccatcatcgccatcgccaccacctgcaaccgccgcaagaaggaggtgcgcaaagggggggccctccgggaagagcggcccggggcggcgggcggcggagcctcggctcccggctccccggaggaggccgcccggggagccgggcccaggcccaacatgttcgacgtgctcaccttccctggcaccggcaaagcgccctttggcagccccgcggcggacgcgcctccgcctgcggtcgccgcggccgaagtgccgggctcagagggcggcagcgccactggggaaagcgcctgtcacttcgaggggcagcagcggctccgcggcgcgcacgccgagccctacggtgcctccccgggttttggaaaggagccggcgccccctgtggcggtgtggaaaggacactccttcaacaccatttctggcagagaagcagagaagttcagcggcaaagacagcggtaaaggggacagtgatttcaacgacagcgattccgacatcagcggggacgctctgaaaaaggatctcatcaaccacatgcagagtggactgtgggcgtgcaccgctgagtgtaagatcctgggccactctgaccgctgctggagcccatcctgcagcgggcccaacgcacatccatcgcctcacccaccagcccagatgtcaaccttctgtaagagcacgtcactgcctcgggatcctctgcgcagggacaattactaccaggcccagctgcccaagacagtggggctgcagagcgtctatgagaaagtactgcacagagactatgacaggacagtcactctgctctcccctccccgtccagggaggctcccagacctgcaggagattggagtacccctctaccagtcccctcctggcaggtacctgtccccgaagaagggagccaatgaaaatgtgtaatcccatgctgcatgtcttcacacatatacaggtcactccgagaagcccctaagttattgaccggtttcagtgttgtatatataaatatgcaagatgtgccttacaatgaagttgttggaagctatttccaatcacattggtactgtttggtatttgc

SEQ ID NO: 24838 - DNA, 3663 bp, Homo sapiens
atggacctgagggatttttacctgttggctgctctgattgcctgtttaaggctggattccgcaatagctcaagaacttatttacactattagagaggaattgcctgaaaatgtgcccataggaaacataccaaaggatctgaacatttctcacatcaatgctgccacagggaccagcgccagccttgtctacagactggtttctaaagctggggatgcccctttggtgaaagtttccagcagcactggggaaattttcacaacctccaacagaatagacagagaaaaactctgtgctggcgcctcatatgctgaggagaatgagtgtttctttgaacttgaggtggtgatcctccccaatgatttcttcaggctgatcaaaataaaaataattgtcaaggataccaatgataatgcccccatgtttccatctcctgtcatcaatatttccattccagaaaacactttgatcaacagccgctttccaattccatcagcaacagatcctgacacaggcttcaatggtgtacagcattatgaattgttaaatgggcagagtgtttttggactggatatcgtggaaactccagagggagagaagtggccacaactgattgttcagcaaaacttggatagagaacagaaagatacctatgtgatgaaaatcaaagtagaggatggaggcactccacagaaatccagtacggccatactgcaggtcacagtaagtgatgtaaatgacaacaggccagtgtttaaagagggtcaagtggaggtgcatattccagagaatgctcccgtaggtacctctgtaattcagctccatgccactgatgcagatataggcagtaatgctgaaatccggtacatttttggtgcccaggtcgcccctgcaaccaaaagactctttgctttaaataatactactgggctgattacagttcagaggtccttagatagagaggagacagccattcacaaagtgacagtgctggctagtgacggcagctccactcctgctcgagcaacggttaccatcaatgtcaccgatgtaaatgataaccctcctaatatagacctcaggtacattataagtcccatcaatggcaccgtgtatttatctgagaaagatcctgtcaatacaaagattgccctaattacagtttcagataaggacacagatgtgaatggcaaagtgatctgttttattgaaagagaggtcccatttcatttgaaggcggtatatgacaaccaatatttgttagagacctcttctttgttggactatgagggcaccaaagaattcagctttaaaattgttgcctctgattctgggaagcccagtttaaatcagactgccctggtaagggttaagcttgaggatgaaaatgacaacccaccaattttcaaccagcctgtaattgagctgtcagtttctgaaaacaaccgacgtgggttatacttaacaactattagtgccacagatgaagacagtgggaaaaatgcagacattgtttatcagcttggaccgaatgcctccttctttgatctggaccgaaaaacaggagttttgacagcctccagagtatttgacagagaagaacaagaacgattcatttttacagtaactgccagggacaatgggacccctcccctccaaagccaagcggctgtgattgttactgttctggatgagaatgacaatagccccaagtttactcataatcattttcaattttttgtgtctgagaatctgccaaagtatagtactgtgggggtaatcacagtgacagatgcagatgctggagagaataaagctgtgactctttccattctaaatgacaatgataattttgtgttggatccctattctggagtcataaagtcaaatgtctcatttgatagagagcagcagagttcctacacttttgatgtcaaagccactgatggaggacaaccacctcgttcctctactgcaaaagtaactatcaacgtcatggatgtcaatgacaacagcccagttgtcatttctccaccgtctaatacttcctttaagttggtgcccctctcagccattcctggctccgtggtagcagaagtttttgcagtggatgttgacactggaatgaacgctgaactaaagtatactatagtgagtggaaacaataaaggcttattccggattgatccagtaacaggtaacattactctggaagaaaaaccagcacctactgatgtgggattgcatcgtttggtggtcaacataagtgacctggggtaccctaagtctttgcacacgcttgtgcttgtattcctttatgttaacgacactgctggaaatgcctcctatatctatgacttgatccgcaggactatggagaccccgttggacaggaacataggggatagtagccaaccctatcaaaatgaggactatctaaccatcatgattgccatcatcgccggtgccatggtggtcattgttgtgatcttcgtcaccgttctggtgcgctgtcgccatgcatcaaggttcaaagcagctcagaggagcaagcaaggtgccgaatggatgtccccaaaccaggagaacaagcaaaacaagaaaaagaaaagaaagaaaaggaagtctcccaaaagctctcttttgaactttgttactatcgaagagtccaaacccgatgatgcagttcatgaacctatcaatgggacaataagcctgccggctgaactggaggagcaaagtataggaagatttgactggggcccggcacctccaacaacattcaagcctaacagtcctgacctggccaagcactacaaatctgcttctccacagcctgcttttcatctcaaaccagacactccagtttccgtgaaaaagcaccacgtgattcaggaactccctttggacaacacctttgttgggggttgtgacaccctttctaaacgctcttccactagttcagatcacttcagtgcctcagagtgcagttcccaaggaggcttcaagacaaagggccccttacacaccagacagtcgcagcgccgtgttacgtttcatctccctgatggctcccaggaaagctgcagtgacagtggtctaggagaccatgagccggtgggtagtggaaccctgatctcacaccctcttcctctggttcagccacaggacgaattctatgaccaggcctctccggacaagaggactgaagcagatggcaactctgatcccaactctgatgggcctttgggtccccgaggattagctgaagctacagagatgtgcactcaagagtgcttggttttgggtcactctgataattgctggatgcctcctggcttgggtccatatcaacaccccaaatctcctctctcaacctttgcaccccagaaagaatgggtgaagaaggacaagcttgtgaatgggcacaccctgaccagagcctggaaagaagacagcaacaggaaccagttcaatgaccgtaagcagtatggctccaatgaaggccatttcaacaatggcagccacatgacagacattcctctggcaaatctgaagtcttataagcaagcaggaggtgctactgagagtcctaaggagcaccaactctaagaaaaggctatatgggacctaataactttaaatagacatgctaataccgtg

SEQ ID NO: 24839 - DNA, 4397 bp, Homo sapiens
agagagaggagagggagaaggagagaggggcagaggggaagggagagagggagagcacgcgagacggaaaggagcgcctcagagtctctgaagcacgcaagagataaccgattaggaatttttcgggcaactgtcacccggatagctgtcagagaatcatcatcaccgcaactctgacgtttcctacaagaagttagagacttaagcagtattggcatcggatggaaatggtatgcatgctgctgtggaaaatatccctgagctgaagaagtgcaactatgtgttgtgtgtgctaaatgcccagaagaacccagacccagtgggtaagagagacgaaatgtggagagaatgactaacgacaaatccgtgaatttgttctctggagttgctaatttgccagcccgaagcaacacattttacaaggaggaaacattttgctgcttctgatttctccccaaactggtgctaccagatgcatggctttctatgtgttggaacaaatcattcctaactgcagcatactgggaaaggggaaaggttgaggcaactaaccggctgtctccaaataagtgatgagatataatgcatcctccagtccatgcacgcttcctcttgcaatttgtgcatcattcctcagtggaaacctttaaaccctaaaatccaggaaaagaaaataaatacattatcatggacctgagggatttttacctgttggctgctctgattgcctgtttaaggctggattccgcaatagctcaagaacttatttacactattagagaggaattgcctgaaaatgtgcccataggaaacataccaaaggatctgaacatttctcacatcaatgctgccacagggaccagcgccagccttgtctacagactggtttctaaagctggggatgcccctttggtgaaagtttccagcagcactggggaaattttcacaacctccaacagaatagacagagaaaaactctgtgctggcgcctcatatgctgaggagaatgagtgtttctttgaacttgaggtggtgatcctccccaatgatttcttcaggctgatcaaaataaaaataattgtcaaggataccaatgataatgcccccatgtttccatctcctgtcatcaatatttccattccagaaaacactttgatcaacagccgctttccaattccatcagcaacagatcctgacacaggcttcaatggtgtacagcattatgaattgttaaatgggcagagtgtttttggactggatatcgtggaaactccagagggagagaagtggccacaactgattgttcagcaaaacttggatagagaacagaaagatacctatgtgatgaaaatcaaagtagaggatggaggcactccacagaaatccagtacggccatactgcaggtcacagtaagtgatgtaaatgacaacaggccagtgtttaaagagggtcaagtggaggtgcatattccagagaatgctcccgtaggtacctctgtaattcagctccatgccactgatgcagatataggcagtaatgctgaaatccggtacatttttggtgcccaggtcgcccctgcaaccaaaagactctttgctttaaataatactactgggctgattacagttcagaggtccttagatagagaggagacagccattcacaaagtgacagtgctggctagtgacggcagctccactcctgctcgagcaacggttaccatcaatgtcaccgatgtaaatgataaccctcctaatatagacctcaggtacattataagtcccatcaatggcaccgtgtatttatctgagaaagatcctgtcaatacaaagattgccctaattacagtttcagataaggacacagatgtgaatggcaaagtgatctgttttattgaaagagaggtcccatttcatttgaaggcggtatatgacaaccaatatttgttagagacctcttctttgttggactatgagggcaccaaagaattcagctttaaaattgttgcctctgattctgggaagcccagtttaaatcagactgccctggtaagggttaagcttgaggatgaaaatgacaacccaccaattttcaaccagcctgtaattgagctgtcagtttctgaaaacaaccgacgtgggttatacttaacaactattagtgccacagatgaagacagtgggaaaaatgcagacattgtttatcagcttggaccgaatgcctccttctttgatctggaccgaaaaacaggagttttgacagcctccagagtatttgacagagaagaacaagaacgattcatttttacagtaactgccagggacaatgggacccctcccctccaaagccaagcggctgtgattgttactgttctggatgagaatgacaatagccccaagtttactcataatcattttcaattttttgtgtctgagaatctgccaaagtatagtactgtgggggtaatcacagtgacagatgcagatgctggagagaataaagctgtgactctttccattctaaatgacaatgataattttgtgttggatccctattctggagtcataaagtcaaatgtctcatttgatagagagcagcagagttcctacacttttgatgtcaaagccactgatggaggacaaccacctcgttcctctactgcaaaagtaactatcaacgtcatggatgtcaatgacaacagcccagttgtcatttctccaccgtctaatacttcctttaagttggtgcccctctcagccattcctggctccgtggtagcagaagtttttgcagtggatgttgacactggaatgaacgctgaactaaagtatactatagtgagtggaaacaataaaggcttattccggattgatccagtaacaggtaacattactctggaagaaaaaccagcacctactgatgtgggattgcatcgtttggtggtcaacataagtgacctggggtaccctaagtctttgcacacgcttgtgcttgtattcctttatgttaacgacactgctggaaatgcctcctatatctatgacttgatccgcaggactatggagaccccgttggacaggaacataggggatagtagccaaccctatcaaaatgaggactatctaaccatcatgattgccatcatcgccggtgccatggtggtcattgttgtgatcttcgtcaccgttctggtgcgctgtcgccatgcatcaaggttcaaagcagctcagaggagcaagcaaggtgccgaatggatgtccccaaaccaggagaacaagcaaaacaagaaaaagaaaagaaagaaaaggaagtctcccaaaagctctcttttgaactttgttactatcgaagagtccaaacccgatgatgcagttcatgaacctatcaatgggacaataagcctgccggctgaactggaggagcaaagtataggaagatttgactggggcccggcacctccaacaacattcaagcctaacagtcctgacctggccaagcactacaaatctgcttctccacagcctgcttttcatctcaaaccagacactccagtttccgtgaaaaagcaccacgtgattcaggaactccctttggacaacacctttgttgggggttgtgacaccctttctaaacgctcttccactagttcagatcacttcagtgcctcagagtgcagttcccaaggaggcttcaagacaaagggccccttacacaccagacaggtaaacgagcacttttactggtctataagtactgcatacaagtgcccagtcaaccagtattaacgtgccagtatgtctattgttttggtctaactttagcttagttagaaagaggtaaaaaaaaacttgaccccttttctattcctctggggctcagtcaagaatttttagaacagctttgaaatttctgagttctgagaatattttctcctttcagtttccttcaaatggcaaaagatgaaaagagaaaattattccaaaatgtcccaagataatgtttgctgaagaagaaaaaacctgtcctgatatgccaaattctgctcctgggggtttccaaattgactgcttcaagactttcaccttaccttttgatctaaaaagtcaccttcaaatctcaagttttcaatgacttttgaaggtgtgactgcaattatgttgcagctatggttgctaaaggggttaattttttttttagtctctaaacaggatagtagaatattaaatgtacatcagctgtgaagcacatgatcgttgatagattgcaactaagccatataggaagtcttctctttgatttcaaattattttattgtaatatattaaattcggtacttaatagaaagatttttagtgtccgcagtggccaaatactctttcaaaaaaaaaaaaaaaaa

SEQ ID NO: 24840 - DNA, 5667 bp, Homo sapiens
cggctgtctccaaataagtgatgagatataatgcatcctccagtccatgcacgcttcctcttgcaatttgtgcatcattcctcagtggaaacctttaaaccctaaaatccaggaaaagaaaataaatacattatcatggacctgagggatttttacctgttggctgctctgattgcctgtttaaggctggattccgcaatagctcaagaacttatttacactattagagaggaattgcctgaaaatgtgcccataggaaacataccaaaggatctgaacatttctcacatcaatgctgccacagggaccagcgccagccttgtctacagactggtttctaaagctggggatgcccctttggtgaaagtttccagcagcactggggaaattttcacaacctccaacagaatagacagagaaaaactctgtgctggcgcctcatatgctgaggagaatgagtgtttctttgaacttgaggtggtgatcctccccaatgatttcttcaggctgatcaaaataaaaataattgtcaaggataccaatgataatgcccccatgtttccatctcctgtcatcaatatttccattccagaaaacactttgatcaacagccgctttccaattccatcagcaacagatcctgacacaggcttcaatggtgtacagcattatgaattgttaaatgggcagagtgtttttggactggatatcgtggaaactccagagggagagaagtggccacaactgattgttcagcaaaacttggatagagaacagaaagatacctatgtgatgaaaatcaaagtagaggatggaggcactccacagaaatccagtacggccatactgcaggtcacagtaagtgatgtaaatgacaacaggccagtgtttaaagagggtcaagtggaggtgcatattccagagaatgctcccgtaggtacctctgtaattcagctccatgccactgatgcagatataggcagtaatgctgaaatccggtacatttttggtgcccaggtcgcccctgcaaccaaaagactctttgctttaaataatactactgggctgattacagttcagaggtccttagatagagaggagacagccattcacaaagtgacagtgctggctagtgacggcagctccactcctgctcgagcaacggttaccatcaatgtcaccgatgtaaatgataaccctcctaatatagacctcaggtacattataagtcccatcaatggcaccgtgtatttatctgagaaagatcctgtcaatacaaagattgccctaattacagtttcagataaggacacagatgtgaatggcaaagtgatctgttttattgaaagagaggtcccatttcatttgaaggcggtatatgacaaccaatatttgttagagacctcttctttgttggactatgagggcaccaaagaattcagctttaaaattgttgcctctgattctgggaagcccagtttaaatcagactgccctggtaagggttaagcttgaggatgaaaatgacaacccaccaattttcaaccagcctgtaattgagctgtcagtttctgaaaacaaccgacgtgggttatacttaacaactattagtgccacagatgaagacagtgggaaaaatgcagacattgtttatcagcttggaccgaatgcctccttctttgatctggaccgaaaaacaggagttttgacagcctccagagtatttgacagagaagaacaagaacgattcatttttacagtaactgccagggacaatgggacccctcccctccaaagccaagcggctgtgattgttactgttctggatgagaatgacaatagccccaagtttactcataatcattttcaattttttgtgtctgagaatctgccaaagtatagtactgtgggggtaatcacagtgacagatgcagatgctggagagaataaagctgtgactctttccattctaaatgacaatgataattttgtgttggatccctattctggagtcataaagtcaaatgtctcatttgatagagagcagcagagttcctacacttttgatgtcaaagccactgatggaggacaaccacctcgttcctctactgcaaaagtaactatcaacgtcatggatgtcaatgacaacagcccagttgtcatttctccaccgtctaatacttcctttaagttggtgcccctctcagccattcctggctccgtggtagcagaagtttttgcagtggatgttgacactggaatgaacgctgaactaaagtatactatagtgagtggaaacaataaaggcttattccggattgatccagtaacaggtaacattactctggaagaaaaaccagcacctactgatgtgggattgcatcgtttggtggtcaacataagtgacctggggtaccctaagtctttgcacacgcttgtgcttgtattcctttatgttaacgacactgctggaaatgcctcctatatctatgacttgatccgcaggactatggagaccccgttggacaggaacataggggatagtagccaaccctatcaaaatgaggactatctaaccatcatgattgccatcatcgccggtgccatggtggtcattgttgtgatcttcgtcaccgttctggtgcgctgtcgccatgcatcaaggttcaaagcagctcagaggagcaagcaaggtgccgaatggatgtccccaaaccaggagaacaagcaaaacaagaaaaagaaaagaaagaaaaggaagtctcccaaaagctctcttttgaactttgttactatcgaagagtccaaacccgatgatgcagttcatgaacctatcaatgggacaataagcctgccggctgaactggaggagcaaagtataggaagatttgactggggcccggcacctccaacaacattcaagcctaacagtcctgacctggccaagcactacaaatctgcttctccacagcctgcttttcatctcaaaccagacactccagtttccgtgaaaaagcaccacgtgattcaggaactccctttggacaacacctttgttgggggttgtgacaccctttctaaacgctcttccactagttcagatcacttcagtgcctcagagtgcagttcccaaggaggcttcaagacaaagggccccttacacaccagacagtgtaactcacacagcaaaagtgacaatattcctgtcactcctcagaaatgtcccagctccacgggtttccacattcaggagaatgaagaaagccattacgagtcgcagcgccgtgttacgtttcatctccctgatggctcccaggaaagctgcagtgacagtggtctaggagaccatgagccggtgggtagtggaaccctgatctcacaccctcttcctctggttcagccacaggacgaattctatgaccaggcctctccggacaagaggactgaagcagatggcaactctgatcccaactctgatgggcctttgggtccccgaggattagctgaagctacagagatgtgcactcaagagtgcttggttttgggtcactctgataattgctggatgcctcctggcttgggtccatatcaacaccccaaatctcctctctcaacctttgcaccccagaaagaatgggtgaagaaggacaagcttgtgaatgggcacaccctgaccagagcctggaaagaagacagcaacaggaaccagttcaatgaccgtaagcagtatggctccaatgaaggccatttcaacaatggcagccacatgacagacattcctctggcaaatctgaagtcttataagcaagcaggaggtgctactgagagtcctaaggagcaccaactctaagaaaaggctatatgggacctaataactttaaatagacatgctaataccgtgtgcgtcagagctttatgtattcaatagatctctacaactatgccccttctagcagggatacctataactttgtgttagcaccatggagaatacaatgtttttgcaacatatgagagaagatagttctagccatgcaattttgtttactagaattgattacactctccagagatctctccattgtgcaaattttttttattattgcattttattttgaccctggactgctgctatgaacaatagaatatgcatttggaaagtaagaaagtttcatggattagagtgactgaaaaacatatccagttagaaaattgtgcttttttttttttttttttttttttttgtcattgatttgtgctgggactgctatacttgacattatactgcaaacaaaacttaaagagataagcattaaacctattgtgctgttaacaacgttagtggacacttgtaagtcaatcagtgttaaagtatttgtaaatagaagcaagctattattaacaacttttgtgtacttataatgttcacctaaaaatgttgtagcataattctgtgttttatggttgcttctgtccttctttttatttacctctttgttgttatttttgttgtttctttcagtgaggtgtttctgtgttagtagtctgtcttgacacacattgttcaaacaatctcaagcacttgtgtttaaaaaaggttctgaaatcttgcttctcatatgatagcttatgatgccggaattctgtaaacaataaagatgaaagaaaaaatgaaaactttatacaaaaaaggacttctgcaaaagcttggaaattcagaacctattttttatcatcttattttcaaagtaggcaaaagcaaaatcacttaattagtaccattaagtgagagagtaatggaaaactgttatccatcaaaagtgatataatatcctgtacttgtcactcatgtaaaactaatgtatcaaaattagcatatatggaagaaaaatcactattcaaaaatagtttcaattgggcaaatgtgtgtctacaactttgttgaaatggcagagtctgtgttgatcctcatatacaataatgttgttgtaacacaagtgttattagaccatagccacaaaatatttaatgtgttgtgccttcatgatgtaacagaacattctccaggtagggtagttgggggaaataaagggataaatctctaattattgctgtttaactgtttgttatcatagttggtcaatgcctggcaggtaccagcatattgtcacttaggtcaaaccaataaagtgacaactaatgttaataagatctcagttgcacgtgcaaacaaatccaaattcgaacattcttaggaggtttttgttaaggcatgacagatgatttaaacaaataaatagcatgcaacaaaatgtctttattgaaagaagtggaagttatcttaatgccacggttcaccatcaatttaaaagtaaaaaaaacaaaaaaaaaacaaaaaatttaaaaaaaaggtttgctaatctgatagttaatttgttcttaccaaaaaataaaattactttgtaaatagcagttcacatttttccacagtataatggaaaataatgggtaggggtgcattgcttattgaagtacatttttgtcggtttgtgaggggtgtttgatgactttgacagaataaatatctaaacaattatccttgttactgctttgccagttctacgttatttacaattattcagctcttgcaataaatgttctgaattcc

SEQ ID NO: 24841 - DNA, 5834 bp, Homo sapiens
agagagaggagagggagaaggagagaggggcagaggggaagggagagagggagagcacgcgagacggaaaggagcgcctcagagtctctgaagcacgcaagagataaccgattaggaatttttcgggcaactgtcacccggatagctgtcagagaatcatcatcaccgcaactctgacgtttcctacaagaagttagagacttaagcagtattggcatcggatggaaatggtatgcatgctgctgtggaaaatatccctgagctgaagaagtgcaactatgtgttgtgtgtgctaaatgcccagaagaacccagacccagtgggtaagagagacgaaatgtggagagaatgactaacgacaaatccgtgaatttgttctctggagttgctaatttgccagcccgaagcaacacattttacaaggaggaaacattttgctgcttctgatttctccccaaactggtgctaccagatgcatggctttctatgtgttggaacaaatcattcctaactgcagcatactgggaaaggggaaaggttgaggcaactaaccggctgtctccaaataagtgatgagatataatgcatcctccagtccatgcacgcttcctcttgcaatttgtgcatcattcctcagtggaaacctttaaaccctaaaatccaggaaaagaaaataaatacattatcatggacctgagggatttttacctgttggctgctctgattgcctgtttaaggctggattccgcaatagctcaagaacttatttacactattagagaggaattgcctgaaaatgtgcccataggaaacataccaaaggatctgaacatttctcacatcaatgctgccacagggaccagcgccagccttgtctacagactggtttctaaagctggggatgcccctttggtgaaagtttccagcagcactggggaaattttcacaacctccaacagaatagacagagaaaaactctgtgctggcgcctcatatgctgaggagaatgagtgtttctttgaacttgaggtggtgatcctccccaatgatttcttcaggctgatcaaaataaaaataattgtcaaggataccaatgataatgcccccatgtttccatctcctgtcatcaatatttccattccagaaaacactttgatcaacagccgctttccaattccatcagcaacagatcctgacacaggcttcaatggtgtacagcattatgaattgttaaatgggcagagtgtttttggactggatatcgtggaaactccagagggagagaagtggccacaactgattgttcagcaaaacttggatagagaacagaaagatacctatgtgatgaaaatcaaagtagaggatggaggcactccacagaaatccagtacggccatactgcaggtcacagtaagtgatgtaaatgacaacaggccagtgtttaaagagggtcaagtggaggtgcatattccagagaatgctcccgtaggtacctctgtaattcagctccatgccactgatgcagatataggcagtaatgctgaaatccggtacatttttggtgcccaggtcgcccctgcaaccaaaagactctttgctttaaataatactactgggctgattacagttcagaggtccttagatagagaggagacagccattcacaaagtgacagtgctggctagtgacggcagctccactcctgctcgagcaacggttaccatcaatgtcaccgatgtaaatgataaccctcctaatatagacctcaggtacattataagtcccatcaatggcaccgtgtatttatctgagaaagatcctgtcaatacaaagattgccctaattacagtttcagataaggacacagatgtgaatggcaaagtgatctgttttattgaaagagaggtcccatttcatttgaaggcggtatatgacaaccaatatttgttagagacctcttctttgttggactatgagggcaccaaagaattcagctttaaaattgttgcctctgattctgggaagcccagtttaaatcagactgccctggtaagggttaagcttgaggatgaaaatgacaacccaccaattttcaaccagcctgtaattgagctgtcagtttctgaaaacaaccgacgtgggttatacttaacaactattagtgccacagatgaagacagtgggaaaaatgcagacattgtttatcagcttggaccgaatgcctccttctttgatctggaccgaaaaacaggagttttgacagcctccagagtatttgacagagaagaacaagaacgattcatttttacagtaactgccagggacaatgggacccctcccctccaaagccaagcggctgtgattgttactgttctggatgagaatgacaatagccccaagtttactcataatcattttcaattttttgtgtctgagaatctgccaaagtatagtactgtgggggtaatcacagtgacagatgcagatgctggagagaataaagctgtgactctttccattctaaatgacaatgataattttgtgttggatccctattctggagtcataaagtcaaatgtctcatttgatagagagcagcagagttcctacacttttgatgtcaaagccactgatggaggacaaccacctcgttcctctactgcaaaagtaactatcaacgtcatggatgtcaatgacaacagcccagttgtcatttctccaccgtctaatacttcctttaagttggtgcccctctcagccattcctggctccgtggtagcagaagtttttgcagtggatgttgacactggaatgaacgctgaactaaagtatactatagtgagtggaaacaataaaggcttattccggattgatccagtaacaggtaacattactctggaagaaaaaccagcacctactgatgtgggattgcatcgtttggtggtcaacataagtgacctggggtaccctaagtctttgcacacgcttgtgcttgtattcctttatgttaacgacactgctggaaatgcctcctatatctatgacttgatccgcaggactatggagaccccgttggacaggaacataggggatagtagccaaccctatcaaaatgaggactatctaaccatcatgattgccatcatcgccggtgccatggtggtcattgttgtgatcttcgtcaccgttctggtgcgctgtcgccatgcatcaaggttcaaagcagctcagaggagcaagcaaggtgccgaatggatgtccccaaaccaggagaacaagcaaaacaagaaaaagaaaagaaagaaaaggaagtctcccaaaagctctcttttgaactttgttactatcgaagagtccaaacccgatgatgcagttcatgaacctatcaatgggacaataagcctgccggctgaactggaggagcaaagtataggaagatttgactggggcccggcacctccaacaacattcaagcctaacagtcctgacctggccaagcactacaaatctgcttctccacagcctgcttttcatctcaaaccagacactccagtttccgtgaaaaagcaccacgtgattcaggaactccctttggacaacacctttgttgggggttgtgacaccctttctaaacgctcttccactagttcagatcacttcagtgcctcagagtgcagttcccaaggaggcttcaagacaaagggccccttacacaccagacagtcgcagcgccgtgttacgtttcatctccctgatggctcccaggaaagctgcagtgacagtggtctaggagaccatgagccggtgggtagtggaaccctgatctcacaccctcttcctctggttcagccacaggacgaattctatgaccaggcctctccggacaagaggactgaagcagatggcaactctgatcccaactctgatgggcctttgggtccccgaggattagctgaagctacagagatgtgcactcaagagtgcttggttttgggtcactctgataattgctggatgcctcctggcttgggtccatatcaacaccccaaatctcctctctcaacctttgcaccccagaaagaatgggtgaagaaggacaagcttgtgaatgggcacaccctgaccagagcctggaaagaagacagcaacaggaaccagttcaatgaccgtaagcagtatggctccaatgaaggccatttcaacaatggcagccacatgacagacattcctctggcaaatctgaagtcttataagcaagcaggaggtgctactgagagtcctaaggagcaccaactctaagaaaaggctatatgggacctaataactttaaatagacatgctaataccgtgtgcgtcagagctttatgtattcaatagatctctacaactatgccccttctagcagggatacctataactttgtgttagcaccatggagaatacaatgtttttgcaacatatgagagaagatagttctagccatgcaattttgtttactagaattgattacactctccagagatctctccattgtgcaaattttttttattattgcattttattttgaccctggactgctgctatgaacaatagaatatgcatttggaaagtaagaaagtttcatggattagagtgactgaaaaacatatccagttagaaaattgtgcttttttttttttttttttttttttttgtcattgatttgtgctgggactgctatacttgacattatactgcaaacaaaacttaaagagataagcattaaacctattgtgctgttaacaacgttagtggacacttgtaagtcaatcagtgttaaagtatttgtaaatagaagcaagctattattaacaacttttgtgtacttataatgttcacctaaaaatgttgtagcataattctgtgttttatggttgcttctgtccttctttttatttacctctttgttgttatttttgttgtttctttcagtgaggtgtttctgtgttagtagtctgtcttgacacacattgttcaaacaatctcaagcacttgtgtttaaaaaaggttctgaaatcttgcttctcatatgatagcttatgatgccggaattctgtaaacaataaagatgaaagaaaaaatgaaaactttatacaaaaaaggacttctgcaaaagcttggaaattcagaacctattttttatcatcttattttcaaagtaggcaaaagcaaaatcacttaattagtaccattaagtgagagagtaatggaaaactgttatccatcaaaagtgatataatatcctgtacttgtcactcatgtaaaactaatgtatcaaaattagcatatatggaagaaaaatcactattcaaaaatagtttcaattgggcaaatgtgtgtctacaactttgttgaaatggcagagtctgtgttgatcctcatatacaataatgttgttgtaacacaagtgttattagaccatagccacaaaatatttaatgtgttgtgccttcatgatgtaacagaacattctccaggtagggtagttgggggaaataaagggataaatctctaattattgctgtttaactgtttgttatcatagttggtcaatgcctggcaggtaccagcatattgtcacttaggtcaaaccaataaagtgacaactaatgttaataagatctcagttgcacgtgcaaacaaatccaaattcgaacattcttaggaggtttttgttaaggcatgacagatgatttaaacaaataaatagcatgcaacaaaatgtctttattgaaagaagtggaagttatcttaatgccacggttcaccatcaatttaaaagtaaaaaaaacaaa

SEQ ID NO: 24842 - DNA, 6226 bp, Homo sapiens
agttcagagagaggagagggagaaggagagaggggcagaggggaagggagagagggagagcacgcgagacggaaaggagcgcctcagagtctctgaagcacgcaagagataaccgattaggaatttttcgggcaactgtcacccggatagctgtcagagaatcatcatcaccgcaactctgacgtttcctacaagaagttagagacttaagcagtattggcatcggatggaaatggtatgcatgctgctgtggaaaatatccctgagctgaagaagtgcaactatgtgttgtgtgtgctaaatgcccagaagaacccagacccagtgggtaagagagacgaaatgtggagagaatgactaacgacaaatccgtgaatttgttctctggagttgctaatttgccagcccgaagcaacacattttacaaggaggaaacattttgctgcttctgatttctccccaaactggtgctaccagatgcatggctttctatgtgttggaacaaatcattcctaactgcagcatactgggaaaggggaaaggttgaggcaactaaccggctgtctccaaataagtgatgagatataatgcatcctccagtccatgcacgcttcctcttgcaatttgtgcatcattcctcagtggaaacctttaaaccctaaaatccaggaaaagaaaataaatacattatcatggacctgagggatttttacctgttggctgctctgattgcctgtttaaggctggattccgcaatagctcaagaacttatttacactattagagaggaattgcctgaaaatgtgcccataggaaacataccaaaggatctgaacatttctcacatcaatgctgccacagggaccagcgccagccttgtctacagactggtttctaaagctggggatgcccctttggtgaaagtttccagcagcactggggaaattttcacaacctccaacagaatagacagagaaaaactctgtgctggcgcctcatatgctgaggagaatgagtgtttctttgaacttgaggtggtgatcctccccaatgatttcttcaggctgatcaaaataaaaataattgtcaaggataccaatgataatgcccccatgtttccatctcctgtcatcaatatttccattccagaaaacactttgatcaacagccgctttccaattccatcagcaacagatcctgacacaggcttcaatggtgtacagcattatgaattgttaaatgggcagagtgtttttggactggatatcgtggaaactccagagggagagaagtggccacaactgattgttcagcaaaacttggatagagaacagaaagatacctatgtgatgaaaatcaaagtagaggatggaggcactccacagaaatccagtacggccatactgcaggtcacagtaagtgatgtaaatgacaacaggccagtgtttaaagagggtcaagtggaggtgcatattccagagaatgctcccgtaggtacctctgtaattcagctccatgccactgatgcagatataggcagtaatgctgaaatccggtacatttttggtgcccaggtcgcccctgcaaccaaaagactctttgctttaaataatactactgggctgattacagttcagaggtccttagatagagaggagacagccattcacaaagtgacagtgctggctagtgacggcagctccactcctgctcgagcaacggttaccatcaatgtcaccgatgtaaatgataaccctcctaatatagacctcaggtacattataagtcccatcaatggcaccgtgtatttatctgagaaagatcctgtcaatacaaagattgccctaattacagtttcagataaggacacagatgtgaatggcaaagtgatctgttttattgaaagagaggtcccatttcatttgaaggcggtatatgacaaccaatatttgttagagacctcttctttgttggactatgagggcaccaaagaattcagctttaaaattgttgcctctgattctgggaagcccagtttaaatcagactgccctggtaagggttaagcttgaggatgaaaatgacaacccaccaattttcaaccagcctgtaattgagctgtcagtttctgaaaacaaccgacgtgggttatacttaacaactattagtgccacagatgaagacagtgggaaaaatgcagacattgtttatcagcttggaccgaatgcctccttctttgatctggaccgaaaaacaggagttttgacagcctccagagtatttgacagagaagaacaagaacgattcatttttacagtaactgccagggacaatgggacccctcccctccaaagccaagcggctgtgattgttactgttctggatgagaatgacaatagccccaagtttactcataatcattttcaattttttgtgtctgagaatctgccaaagtatagtactgtgggggtaatcacagtgacagatgcagatgctggagagaataaagctgtgactctttccattctaaatgacaatgataattttgtgttggatccctattctggagtcataaagtcaaatgtctcatttgatagagagcagcagagttcctacacttttgatgtcaaagccactgatggaggacaaccacctcgttcctctactgcaaaagtaactatcaacgtcatggatgtcaatgacaacagcccagttgtcatttctccaccgtctaatacttcctttaagttggtgcccctctcagccattcctggctccgtggtagcagaagtttttgcagtggatgttgacactggaatgaacgctgaactaaagtatactatagtgagtggaaacaataaaggcttattccggattgatccagtaacaggtaacattactctggaagaaaaaccagcacctactgatgtgggattgcatcgtttggtggtcaacataagtgacctggggtaccctaagtctttgcacacgcttgtgcttgtattcctttatgttaacgacactgctggaaatgcctcctatatctatgacttgatccgcaggactatggagaccccgttggacaggaacataggggatagtagccaaccctatcaaaatgaggactatctaaccatcatgattgccatcatcgccggtgccatggtggtcattgttgtgatcttcgtcaccgttctggtgcgctgtcgccatgcatcaaggttcaaagcagctcagaggagcaagcaaggtgccgaatggatgtccccaaaccaggagaacaagcaaaacaagaaaaagaaaagaaagaaaaggaagtctcccaaaagctctcttttgaactttgttactatcgaagagtccaaacccgatgatgcagttcatgaacctatcaatgggacaataagcctgccggctgaactggaggagcaaagtataggaagatttgactggggcccggcacctccaacaacattcaagcctaacagtcctgacctggccaagcactacaaatctgcttctccacagcctgcttttcatctcaaaccagacactccagtttccgtgaaaaagcaccacgtgattcaggaactccctttggacaacacctttgttgggggttgtgacaccctttctaaacgctcttccactagttcagatcacttcagtgcctcagagtgcagttcccaaggaggcttcaagacaaagggccccttacacaccagacagtgtaactcacacagcaaaagtgacaatattcctgtcactcctcagaaatgtcccagctccacgggtttccacattcaggagaatgaagaaagccattacgagtcgcagcgccgtgttacgtttcatctccctgatggctcccaggaaagctgcagtgacagtggtctaggagaccatgagccggtgggtagtggaaccctgatctcacaccctcttcctctggttcagccacaggacgaattctatgaccaggcctctccggacaagaggactgaagcagatggcaactctgatcccaactctgatgggcctttgggtccccgaggattagctgaagctacagagatgtgcactcaagagtgcttggttttgggtcactctgataattgctggatgcctcctggcttgggtccatatcaacaccccaaatctcctctctcaacctttgcaccccagaaagaatgggtgaagaaggacaagcttgtgaatgggcacaccctgaccagagcctggaaagaagacagcaacaggaaccagttcaatgaccgtaagcagtatggctccaatgaaggccatttcaacaatggcagccacatgacagacattcctctggcaaatctgaagtcttataagcaagcaggaggtgctactgagagtcctaaggagcaccaactctaagaaaaggctatatgggacctaataactttaaatagacatgctaataccgtgtgcgtcagagctttatgtattcaatagatctctacaactatgccccttctagcagggatacctataactttgtgttagcaccatggagaatacaatgtttttgcaacatatgagagaagatagttctagccatgcaattttgtttactagaattgattacactctccagagatctctccattgtgcaaattttttttattattgcattttattttgaccctggactgctgctatgaacaatagaatatgcatttggaaagtaagaaagtttcatggattagagtgactgaaaaacatatccagttagaaaattgtgcttttttttttttttttttttttttttgtcattgatttgtgctgggactgctatacttgacattatactgcaaacaaaacttaaagagataagcattaaacctattgtgctgttaacaacgttagtggacacttgtaagtcaatcagtgttaaagtatttgtaaatagaagcaagctattattaacaacttttgtgtacttataatgttcacctaaaaatgttgtagcataattctgtgttttatggttgcttctgtccttctttttatttacctctttgttgttatttttgttgtttctttcagtgaggtgtttctgtgttagtagtctgtcttgacacacattgttcaaacaatctcaagcacttgtgtttaaaaaaggttctgaaatcttgcttctcatatgatagcttatgatgccggaattctgtaaacaataaagatgaaagaaaaaatgaaaactttatacaaaaaaggacttctgcaaaagcttggaaattcagaacctattttttatcatcttattttcaaagtaggcaaaagcaaaatcacttaattagtaccattaagtgagagagtaatggaaaactgttatccatcaaaagtgatataatatcctgtacttgtcactcatgtaaaactaatgtatcaaaattagcatatatggaagaaaaatcactattcaaaaatagtttcaattgggcaaatgtgtgtctacaactttgttgaaatggcagagtctgtgttgatcctcatatacaataatgttgttgtaacacaagtgttattagaccatagccacaaaatatttaatgtgttgtgccttcatgatgtaacagaacattctccaggtagggtagttgggggaaataaagggataaatctctaattattgctgtttaactgtttgttatcatagttggtcaatgcctggcaggtaccagcatattgtcacttaggtcaaaccaataaagtgacaactaatgttaataagatctcagttgcacgtgcaaacaaatccaaattcgaacattcttaggaggtttttgttaaggcatgacagatgatttaaacaaataaatagcatgcaacaaaatgtctttattgaaagaagtggaagttatcttaatgccacggttcaccatcaatttaaaagtaaaaaaaacaaaaaaaaaacaaaaaatttaaaaaaaaggtttgctaatctgatagttaatttgttcttaccaaaaaataaaattactttgtaaatagcagttcacatttttccacagtataatggaaaataatgggtaggggtgcattgcttattgaagtacatttttgtcggtttgtgaggggtgtttgatgactttgacagaataaatatctaaacaattatccttgttactgctttgccagttctacgttatttacaattattcagctcttgcaataaatgttctgaattcctg

SEQ ID NO: 24843 - DNA, 2571 bp, Homo sapiens
atggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcagagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgccttcgctgtgggccacggccagggtgtccgtggaggtggccgacgtgaatgacaacgcgcctgcgttcgcgcagcccgagtacacagtattcgtgaaggagaacaacccgccgggctgccacatcttcacggtgtctgcgcgggacgcggacgcgcaggagaacgcgctggtgtcctattcgctggtggaacggcgggtgggcgagcgcgcgctgtcgaactacgtgtcagtgcacgcggagagcggcaaggtgtacgcactgcagcccctggaccacgaggagctggagctgctgcagttccaggtgagcgcgcgggatgcgggcgtgccgcctctgggcagcaacgtgacgctgcaggtgttcgtgctggacgagaacgacaacgcgccggcgctgctggcgcctcgagtgggtggcactattggtgcagtcagtgagctggtgccgcgattggtgggtgcgggtcatgtggtggcgaaggtgcgcgcagtggacgccgactcgggctacaacgcgtggctgtcctatgaactgcagccggcagcaggcggcgcgcgcatcccgttccgcgtggggctgtacacgggcgagatcagcacgactcgtgtcctggacgaggctgacttgtcgcgctaccgccttctggtgctagtgaaggatcacggtgagccggcgctgacagccacggccactgtgcttgtatctctggtggagagcggccaggcgccaaaggcgtcttcgcgggcgtcggtgggtgtcgcgggcccagaggcggcgctggtggatgtcaacgtgtacctgatcatcgccatctgcgcggtgtccagcctgctggtgctcacactgctgctgtacacggcgctgcggtgctcagtgccgcccactgagggtgcgtatgtgccgggcaagcccactctggtgtgctccagcgcgttggggagctggtcgaactcacagcagaggcggcagagggtgtgctctagcgagggcccacccaagaccgacctcatggccttcagcccaggcctatctccaagtcttaacacgtcagaaagaaatgaacaaccagaagcaaatttggatctttctggtaatgtaagtccaactttcgagttttggctttaaatatttttcatatttaacttgtctaatcatcttttcaaatatcactttaaaaaatgtcttcaaggtgttcactaacgttgaaataaatcataccattgaatgtagatatcctattaatggcagttttgtcttgaatggaactagaaa

SEQ ID NO: 24844 - DNA, 4468 bp, Homo sapiens
atggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcagagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgccttcgctgtgggccacggccagggtgtccgtggaggtggccgacgtgaatgacaacgcgcctgcgttcgcgcagcccgagtacacagtattcgtgaaggagaacaacccgccgggctgccacatcttcacggtgtctgcgcgggacgcggacgcgcaggagaacgcgctggtgtcctattcgctggtggaacggcgggtgggcgagcgcgcgctgtcgaactacgtgtcagtgcacgcggagagcggcaaggtgtacgcactgcagcccctggaccacgaggagctggagctgctgcagttccagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 24845 - DNA, 5260 bp, Homo sapiens
atggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcagagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgccttcgctgtgggccacggccagggtgtccgtggaggtggccgacgtgaatgacaacgcgcctgcgttcgcgcagcccgagtacacagtattcgtgaaggagaacaacccgccgggctgccacatcttcacggtgtctgcgcgggacgcggacgcgcaggagaacgcgctggtgtcctattcgctggtggaacggcgggtgggcgagcgcgcgctgtcgaactacgtgtcagtgcacgcggagagcggcaaggtgtacgcactgcagcccctggaccacgaggagctggagctgctgcagttccaggtgagcgcgcgggatgcgggcgtgccgcctctgggcagcaacgtgacgctgcaggtgttcgtgctggacgagaacgacaacgcgccggcgctgctggcgcctcgagtgggtggcactattggtgcagtcagtgagctggtgccgcgattggtgggtgcgggtcatgtggtggcgaaggtgcgcgcagtggacgccgactcgggctacaacgcgtggctgtcctatgaactgcagccggcagcaggcggcgcgcgcatcccgttccgcgtggggctgtacacgggcgagatcagcacgactcgtgtcctggacgaggctgacttgtcgcgctaccgccttctggtgctagtgaaggatcacggtgagccggcgctgacagccacggccactgtgcttgtatctctggtggagagcggccaggcgccaaaggcgtcttcgcgggcgtcggtgggtgtcgcgggcccagaggcggcgctggtggatgtcaacgtgtacctgatcatcgccatctgcgcggtgtccagcctgctggtgctcacactgctgctgtacacggcgctgcggtgctcagtgccgcccactgagggtgcgtatgtgccgggcaagcccactctggtgtgctccagcgcgttggggagctggtcgaactcacagcagaggcggcagagggtgtgctctagcgagggcccacccaagaccgacctcatggccttcagcccaggcctatctccaagtcttaacacgtcagaaagaaatgaacaaccagaagcaaatttggatctttctggtaatccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 24846 - DNA, 5254 bp, Homo sapiens
atggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 24847 - DNA, 3788 bp, Homo sapiens
ccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagcca

SEQ ID NO: 24848 - DNA, 5257 bp, Homo sapiens
atgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 24849 - DNA, 5233 bp, Homo sapiens
atggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 24850 - DNA, 5260 bp, Homo sapiens
atgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 24851 - DNA, 4884 bp, Homo sapiens
gacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccgaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 24852 - DNA, 2619 bp, Homo sapiens
agaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaaggtgagtcttttactttttcttgccaattctaaaattgttctttttaaaaaattctatatgatttctactagttatttagattcatagttcttcatttattttatatcatcctaccgtgcgatttt

SEQ ID NO: 24853 - DNA, 5254 bp, Homo sapiens
atggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 24854 - DNA, 5260 bp, Homo sapiens
atgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgccgcgcctgttccgggtggcgtccaaaagacacggggaccttctggaggtaaatctgcagaatggcattttgtttgtgaattctcggatagaccgcgaggaactgtgcgggcggagcgcggagtgcagcatccacctggaggtgatcgtggacaggccgctgcaggttttccatgtggaggtggaagtgaaggacattaatgacaacgcgccagtttttccaatggctgtaaagaatctgtttatttccgaatcccgacagcctggctctcggttttcgctagagggcgcatcagatgcagatatcggaacaaattcgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagatgtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagatattctgtcaaaattccatttagatccagtcaatggacaaatcagtgtaaagggtaacatagatttcgaggaaagtaagtcatatgaaatccaggtagaagccacggataaaggaaatcccccaatgtcagatcactgcacagttctactcgaaattgtggacatcaatgataatgtacctgagttagttattcaatcactatctttacctgtattagaagactctccacttagcacagtcatcgctctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccagcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcgtcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtgctctggagaggggttgcccaagaccgacctcatggcttttagccctagccttcctccttgtccaattagccgggatagagaggagaaacaggatgtggacgttgatctctcagccaaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 24855 - DNA, 2475 bp, Homo sapiens
atgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgccgcgcctgttccgggtggcgtccaaaagacacggggaccttctggaggtaaatctgcagaatggcattttgtttgtgaattctcggatagaccgcgaggaactgtgcgggcggagcgcggagtgcagcatccacctggaggtgatcgtggacaggccgctgcaggttttccatgtggaggtggaagtgaaggacattaatgacaacgcgccagtttttccaatggctgtaaagaatctgtttatttccgaatcccgacagcctggctctcggttttcgctagagggcgcatcagatgcagatatcggaacaaattcgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagatgtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagatattctgtcaaaattccatttagatccagtcaatggacaaatcagtgtaaagggtaacatagatttcgaggaaagtaagtcatatgaaatccaggtagaagccacggataaaggaaatcccccaatgtcagatcactgcacagttctactcgaaattgtggacatcaatgataatgtacctgagttagttattcaatcactatctttacctgtattagaagactctccacttagcacagtcatcgctctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccagcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcgtcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtgctctggagaggggttgcccaagaccgacctcatggcttttagccctagccttcctccttgtccaattagccgggatagagaggagaaacaggatgtggacgttgatctctcagccaaagtgagtaatttttatttattctttccaaaatgtctttgtttttcattcctcaatgtttccactcctctggaaatacattaa

SEQ ID NO: 24856 - DNA, 2451 bp, Homo sapiens
atggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttag

SEQ ID NO: 24857 - DNA, 4161 bp, Homo sapiens
aagaaccttccatttttggctgtgccaagaagctcagaaaggcgataatataaaaaatatatagttaattgggaattgaatttacaaaatacattgtgtggtgatgcaatagaaagctcataattggaacgagattgagatggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccgaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagata

SEQ ID NO: 24858 - DNA, 5218 bp, Homo sapiens
atggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 24859 - DNA, 2231 bp, Homo sapiens
atggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctg

SEQ ID NO: 24860 - DNA, 5374 bp, Homo sapiens
gactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 24861 - DNA, 2370 bp, Homo sapiens
atggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataa

SEQ ID NO: 24862 - DNA, 5221 bp, Homo sapiens
atggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 24863 - DNA, 2445 bp, Homo sapiens
atggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtag

SEQ ID NO: 24864 - DNA, 5260 bp, Homo sapiens
atggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 24865 - DNA, 6388 bp, Homo sapiens
ctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctc

SEQ ID NO: 24866 - DNA, 6293 bp, Homo sapiens
acttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 24867 - DNA, 5299 bp, Homo sapiens
atggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatgccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 24868 - DNA, 3084 bp, Homo sapiens
caatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggtt

SEQ ID NO: 24869 - DNA, 5970 bp, Homo sapiens
gttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaagaaa

SEQ ID NO: 24870 - DNA, 2534 bp, Homo sapiens
agtaacctgttgcagaaaagtgaaagtatatccgcaacagttggctctgattgcagagagcgcgcttgtgagaactgatggcgggtacgcgcagaaaatctttgcaaaacaggcaagtgggatctcttctcatttttctgtgcatatctgtgggggatgcgacaactatccgctattcagtggcagaggaaatggagagcggctcgtttgtggccaacgtagctaaggacctaggactggaggtagggaagctggctgcgcgcggggcgcggctggtttccgagggcaacaaaatgcatttccggctccaccgcaagacgggagatttgtttgtgaaggagaaactggatcgggagtcactttgtggcaaagccgacccttgtgttctgcactttgaagtagtcctggtggagccgctgcagtccttccgggccgaggtcagggtatttgatatcaatgacaatgccccagttttcctaaacaaggagccgcttttaaagattccggagagcacccctttgggttcacgttttcctctgcagagcgcccaggatctggacgtgggccttaacggtctccagaactacaccctgagtgccaatgggtatttccacctgcacacccgcttctgcagccacgggcctaaatatgctgagctggtgctgaacaaacccctggaccgagaggagcagcctgaagtcaacttgacaattacggcggtggacggcgggtccccgcctaagtctggcacagctcacatccacgtggtggttctggatgtcaacgaccacgtgccccagttctcgcgactggtgtacagagcccaggtatcagagaacagccccaatggctctttggtggccacggtgactgccgtggacctagacgagggcaccaacaaagcgataacttactctttagctcaaaacccagaagcaattctcaagacgtttcagattgaccctcaaaatggagaagttcgactaagaggacccctcgattttgaagccattgaaacatacgacattgacattcaagctacagatggtggaggcctctctgcccacagcaaagtcctggtagaagtggtggatgtgaatgacaatcctcccgaagtgatggtctcctctgtgtccagcccactccctgaagactcaccaccacagacagtagtagcccttttcactatcagagaccgggacattcgagtgggaggaaaagtcacctgcttcctcagagaagaccttccctttgtaatcaaacctacatttgggaattcttactcactggtcactgacagaagcttggatcgggaggaggtctcaggctataatatcaccattgttgccatggatactggaccacctagcttgtctgccgagactatgatagaggtgctaatatccgacgttaatgacaatcctccaatatttcgggaagattcctatatcttgactgttcgagaaaacaacagtcctgcggtttttattggcaaagtccatgctgaggatcttgatttgggtgagaatgcccaaataacatattctctgttgcctccaaaaaacggagatctttcagtctttgcttacatatccataaattcaggcaatgggaagctctacgcgctgagaaccatggattatgaggccattcaagattttcaatttgtggtaaaggcaactgatgggggcttcctgtcactgagtagccaagttactgtcagagtggttgtcctagatgacaatgacaatcgtccaatgatcttatacccactgcagaacggcaccttgccctgcaatgacctggtgcccaggtctgcagaggcaggctacctagtgaccaaagtggtggctgtggatggtgactcaggtcagaattcttggctttcatatcatctacttaaggccactgaccttgggttattttctgttcaaagacaaaatggagaaatccatacattaaggcagatatctgagagagaccccatgatgcagaaattgatcattcttgttcaggatcacggccaaccagctctttccactactgtctcactcaacatcctgctggtagatggcttttcagagccctacctgcagttccaggatccaaccaagcattctagaaaggtaaatccatccactaaatatttggtcatttctctggtcatcctttcctttctctttctcctctctgtcatagtgatcttcattatacatgtctaccaaaagattaaatatagagaaaagttcacaattcaagagcatttctatgatgactgtaatttctctaacaacctggtacaaggacaaggcaatggatccttatctcggccttgtccatatgaaatgtgttcagccactggcactggtaatagtgagtttcgctttcttaagcgttttatgcccaacttccctttccctcatgccactggggagataaaaatggaggctggctccagtttgcccccaaattctgataggaataagtctcagagattagagggccatgaccaggtatctgatgactatatgtag

SEQ ID NO: 24871 - DNA, 3271 bp, Homo sapiens
atggagaaccaagggacacgcactcagcagataaggcaagtcctgcttctctttgttttgctcggaatgtctcaggcgggctctgaaacctggagcttttctgtggcagaagaaatgcagagcgggagttttgtaggcaatctggcaaaggacctggggctgaaggtgagagaactgtcctcacggggggctcgggtggtctctaatgataagaaacagcgtttgcagctggacataaacactggggatttgctcttaagtgaaacactagacagggaggagctctgcggttccatcgagccttgcgtgctacatttgcaggtgttaatgcaaaaccccacgcagtttttacaaattgagcttcaggtcagggatataaatgatcactctcccatcttctcggaaaaacaaatgctcctagaaatcccagagaacagtcccgttggtgctgtgttcttactagaaagtgcgaaggatttagatgtaggaatcaatgctgtaaaaagctacacaataagccccaactctcattttcacattaaaatgagagtcattccagacaataggaaataccccgagttagttctggacaaggcgctggattatgaagagctcccggagctcagtttcatcctctctgctctggatggtgggtcccctcccaggtctggaactgccttggtcagggtggtggttgtggacattaatgacaactcccctgaatttgagcaggctttttatgaggtgaagattcgggagaatagcatccttggctcgctgattttgattgtctcagcttgggatttagactctggaacaaatggtgaaatatgctataccttttcccatgcctcagaagatattcgcaagacatttgaaattaatcaaaagtctggagaaattactttaagagcacctctggattttgaaacgattgagtcatactcaataatcattcaagccacagatgggggaggactttttggaaaatctacagtcataattcacgtgatagatgtaaatgacaatgctcctgaaatcactgtgtcatcaattaccagtccaatcccagaaaatacgccagagaccgtggttatggtttttagtatccaagatatagactctggggacaacggaagaattgtttgttccattccggaagacctcccattcgtgctaaaatcttcagttgagaattactacacgttggaaacagagagaccactggacagagagagcacagccgagtacaatatcaccatcaccgtcaccgacttggggatacccaggctgaaaaccgagcacaacacaactgtgttggtctctgacgtcaatgacaacgcccccaccttcacccaaacctcctacaccctgttcgtccgcgagaacaacagccccgccctgcacatcggcagtgtcagcgctacagacagagactcaggcaccaacgcccaggtcaactactcgctactcccgccccaggacctgcacctgcccctcgcctccctggtctccatcaacacagacaacggccacctgttcgccctcaggtcgctggactacgaggccctgcaggctttcgacttccgcgtgggcgccacagaccgcggctccccggctttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcaagtgctcctggtggacggcttctcccagccctacctgccgctccctgaggcggcaccggcccaggcccaggccgactcgctcaccgtctacttggtggtggcgttggcctcggtgtcttcgctcttcctcttctcggtgctcctgttcgtggcggtgcggctgtgcaggaggagcagggcggcctcggtgggaagctgctcggtgcctaagggcccctttccagggcatctggtggacgtgagcggcaccgggaccctttcccagagctaccagtacgaggtgtgtctgacgggaggttccgagacaaatgaattcaagttcctaaaaccggttatccctaatatccaggcaaaaggtcttgggaagaatagtgaagaaaactccacctttcgaaatagctttggatttaatttttagtaagaatgctatttacatttgcatgtacttttttagttttatgtaaccatatcaatattatttagtcttaaactagttacgttattatgcaatacgactaattgtatttttaattttttcttttctcccccaattttttttttttttttgagaccgagtctcattctgtcgccctggctggagtgcaatggtgtgatctcagctcactgcaccctccgcctctcgggttcaagcaattctcctgcatcagcctcccgagtagctggcattacaggcgcccaccaccacgctcggctaaattttttttttttttatctttagtagagacggggtttcaccacgttggccgggcaggttttaaactcttgacctcatgttccacccgccacggcctcccaaagtgctgtgattaccggtgtgagccactgcgcccggccttttttttttcttttcttttcttttttttgatacagagtcttagtcacccagactagaggtcagtggcaggatctcagctcactgcaacctctgcctcctgggctcaagagaccagcccacctccgcctccaagtagctgggactacaggcgtgcgccaccatgcccggctacttcttgtattttttgtagagacggatcgtcaccatatttcttaggctggcctttaacttctgagctcaagagatgcactcccctcagcctcccaaagtgctgggattacaggcggccaggcctattttcaattttcaagtattgcatatcattgtgaataacattgtaaatcctttttatattaagtaacaggtagttaatccatttctaatgaataattttaaggttttaatcctttccaagtgtacaataatttactgattatta

SEQ ID NO: 24872 - DNA, 1973 bp, Homo sapiens
gcacacagagaatcagaagacagaaacaacaagccttcaagagggtgacctggaaaccattcaacagggttaaaatccttagaccacagaggatttggtggacaagtcagagacgcgttccgcagagctgaagcctttcttcaagaagcctacaagaaaggaactatggagaaccaagggacacgcactcagcagataaggctttttatgaggtgaagattcgggagaatagcatccttggctcgctgattttgattgtctcagcttgggatttagactctggaacaaatggtgaaatatgctataccttttcccatgcctcagaagatattcgcaagacatttgaaattaatcaaaagtctggagaaattactttaagagcacctctggattttgaaacgattgagtcatactcaataatcattcaagccacagatgggggaggactttttggaaaatctacagtcataattcacgtgatagatgtaaatgacaatgctcctgaaatcactgtgtcatcaattaccagtccaatcccagaaaatacgccagagaccgtggttatggtttttagtatccaagatatagactctggggacaacggaagaattgtttgttccattccggaagacctcccattcgtgctaaaatcttcagttgagaattactacacgttggaaacagagagaccactggacagagagagcacagccgagtacaatatcaccatcaccgtcaccgacttggggatacccaggctgaaaaccgagcacaacacaactgtgttggtctctgacgtcaatgacaacgcccccaccttcacccaaacctcctacaccctgttcgtccgcgagaacaacagccccgccctgcacatcggcagtgtcagcgctacagacagagactcaggcaccaacgcccaggtcaactactcgctactcccgccccaggacctgcacctgcccctcgcctccctggtctccatcaacacagacaacggccacctgttcgccctcaggtcgctggactacgaggccctgcaggctttcgacttccgcgtgggcgccacagaccgcggctccccggctttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcaagtgctcctggtggacggcttctcccagccctacctgccgctccctgaggcggcaccggcccaggcccaggccgactcgctcaccgtctacttggtggtggcgttggcctcggtgtcttcgctcttcctcttctcggtgctcctgttcgtggcggtgcggctgtgcaggaggagcagggcggcctcggtgggaagctgctcggtgcctaagggcccctttccagggcatctggtggacgtgagcggcaccgggaccctttcccagagctaccagtacgaggtgtgtctgacgggaggttccgagacaaatgaattcaagttcctaaaaccggttatccctaatatccaggcaaaaggtcttgggaagaatagtgaagaaaactccacctttcgaaatagctttggatttaatttttagtaagaatgctatttacatttgcatgtacttttttagttttatgtaaccatatcaatattatttagtcttaaactagttacgttattatgcaatacgactaattgtattttt

SEQ ID NO: 24873 - DNA, 396 bp, Homo sapiens
acgattgagtcatactcaataatcattcaagccacagatgggggaggactttttggaaaatctacagtcataattcacgtgatagatgtaaatgacaatgctcctgaaatcactgtgtcatcaattaccagtccaatcccagaaaatacgccagagaccgtggttatggtttttagtatccaagatatagacgggacaacggaagaattgtttgttccattccggaagacctcccatgtgctaaaatcttcagttgagaattactacacgttggaaacagagagaccactggacagagagagcacagccgagtacaatatcaccatcaccgtcaccgacttggggatacccaggctgaaaaccgagcacaacacaactgtgttggtctctgacgtc

SEQ ID NO: 24874 - DNA, 3406 bp, Homo sapiens
agtacacgcggagaactgggaagacagaaagaacaatcctttaagggagaacctagaagccattcaacaaggttaaaatcttcaggcttccgaggatttggtagacagatcagaggcacgtttcccacaactgcgaagaggcgctgaggcaattctgcaagaagattttggggttttggaaaagaagctatggaaaacggaggggcaggcactctgcagataaggcaagtcctgcttttctttgttttgctgggaatgtctcaggcgggctctgaaactgggaactttttggtgatggaggaattgcagagcgggagctttgtaggaaatttggcaaagaccctgggactcgaggtgagtgagctgtcttcgcggggggctcgggtggtttctaatgataacaaagagtgtttgcagctggacacaaacactggggatttgctcctgagagaaatgctagacagggaggagctctgtggctccaatgagccttgtgtgctgtatttccaagtgttaatgaaaaaccccacgcagtttttacaaattgagctccaggtcagggatataaatgatcactctcccgtcttcttggaaaaagaaatgctcttagaaatcccagagaacagtcctgttggtgctgtgttcttgcttgaaagtgcaaaggatttagatgtaggaatcaatgctgtaaaaagctacacaataaatccgaactctcatttccacgttaaaataagagtcaatccagacaataggaaataccctgagttagttctggacaaggcgctggattatgaagagcgcccggagctcagtttcatcctcactgctctggatggcgggtcccctcccaggtctggaactgccttggtcagggtggtggttgtagatattaatgacaactcccctgagtttgagcaggctttttatgaggtgaagattctggagaatagcatccttggctccctggttgtgaccgtctcagcctgggatttagactctggaacaaacagtgaactatcctataccttttcccatgcctcagaagatattcgcaagacatttgaaattaatcaaaagtctggtgacattactttaacagcacctttggattttgaagcaattgagtcatactcaataatcattcaagccacagatgggggaggactttttggaaaatctacagtcagaattcaggtgatggatgtaaacgacaacgctcctgaaatcactgtgtcatcaattaccagtccaatcccagaaaacactccagagactgtggttatggttttcaggatacgagacagagactctggggacaacggaaagatggtttgttctatcccggaggacatcccattcgtgctaaaatcttcggtaaataattactacactttggaaacagagagaccgctggacagagagagcagagccgagtacaacatcaccatcaccgtcaccgacttggggacccccaggctaaaaaccgagcacaacataaccgtgctggtctccgacgtcaatgacaacgcccccgccttcacccaaacttcctacgccctgttcgtccgcgagaacaacagccccgccctgcacatcggcagcatcagcgccacagacagagactcgggcaccaacgcccaggtcaactactcgctgctgccgtcccaggacccgcacctgcccctcgcctccctggtctccatcaacgcggacaacggccacctgtttgccctcaggtcgctggactacgaggccctgcaggggttccagttccgcgtgggcgccacagaccacggctccccggctttgagcagcgaggcgctggtgcgcgtgctggtgctggacgccaacgacaactcgcccttcgtgctgtacccgctgcagaacggctccgcgccctgcaccgagctggtgccctgggcggccgagccgggctacctggtgaccaaggtggtggcggtggacggtgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccggcccaggcccaggccgactcgctcactgtctacctggtggtggcgttggcctcagtgtcgtcgctcttcctcttctcggtgctcctgttcgtggcggtgcggctgtgcaggaggagcagggcggccccggtcggtcgctgctcggtgcctgagggcccctttccaggacatctggtggacgtgagtggcaccgggaccctgtcccagagctaccactatgaggtgtgtgtgactggaggctccaggtcaaataagttcaaatttctgaaaccaattatccccaacttcctaccccagagcacaggtagtgaagtcgaagaaaatcccccatttcagaataatttgggtttctgataaagaatgaaaaataaaacctgtgtttatgaatacatttataattaggaacttatcgtgaggtgcctgtaaagtagtatttttgatcacttcaaatacatactcttcaagtcaagaaataaatttctttacatagaaaaggatacagatttagtaccaagaacacttcacaaagcaggaaatgtgcatgtgtaatggtttatgtcaaacaattatgcttaatataaagtctattaagtggtaagtcttgtttgagatattttaaattgctttccattgttttcaatatttactgtgacttttgttttctgagttgattagaatgctgttcgagtatacctaccctagtttcagaagcatagattgtagtgtacctttttaaactttatttttttaaaaaaagttgttttatgaatcatacactattttcacacttttaatctcagaagaaacatatgtgacatggtattttagtaatgaccaaatagacggtcttagagattcagtaagttcactaaggtccactaactaataagtgacaaaactgagcatccatcctagatctgcctgactctaagtcagtgactttgctcccattccatactgtttttgtcattggatatcacctggcaagtttctgcctaactaaagagaagaaaagtttttatcgtattcatactactgttcaatctttatttagaaataaactttatctatgatttcattttcttataaaccagtaatcttgcttttctgggtaaattttcagctattattactaatgctctgatctgcccaaatcttaagtaaaaaacaaaattgaaagagc

SEQ ID NO: 24875 - DNA, 1254 bp, Homo sapiens
atggtttgttctatcccggaggacatcccattcgtgctaaaatcttcggtaaataattactacactttggaaacagagagaccgctggacagagagagcagagccgagtacaacatcaccatcaccgtcaccgacttggggacccccaggctaaaaaccgagcacaacataaccgtgctggtctccgacgtcaatgacaacgcccccgccttcacccaaacttcctacgccctgttcgtccgcgagaacaacagccccgccctgcacatcggcagcatcagcgccacagacagagactcgggcaccaacgcccaggtcaactactcgctgctgccgtcccaggacccgcacctgcccctcgcctccctggtctccatcaacgcggacaacggccacctgtttgccctcaggtcgctggactacgaggccctgcaggggttccagttccgcgtgggcgccacagaccacggctccccggctttgagcagcgaggcgctggtgcgcgtgctggtgctggacgccaacgacaactcgcccttcgtgctgtacccgctgcagaacggctccgcgccctgcaccgagctggtgccctgggcggccgagccgggctacctggtgaccaaggtggtggcggtggacggtgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccggcccaggcccaggccgactcgctcactgtctacctggtggtggcgttggcctcagtgtcgtcgctcttcctcttctcggtgctcctgttcgtggcggtgcggctgtgcaggaggagcagggcggccccggtcggtcgctgctcggtgcctgagggcccctttccaggacatctggtggacgtgagtggcaccgggaccctgtcccagagctaccactatgaggtgtgtgtgactggaggctccaggtcaaataagttcaaatttctgaaaccaattatccccaacttcctaccccagagcacaggtagtgaagtcgaagaaaatcccccatttcagaataatttgggtttctggatacag

SEQ ID NO: 24876 - DNA, 1963 bp, Homo sapiens
gatgttgtagaccctgttatccagtacacgcggagaactgggaagacagaaagaacaatcctttaagggagaacctagaagccattcaacaaggttaaaatcttcaggcttccgaggatttggtagacagatcagaggcacgtttcccacaactgcgaagaggcgctgaggcaattctgcaagaagattttggggttttggaaaagaagctatggaaaacggaggggcaggcactctgcagataagcacctttggattttgaagcaattgagtcatactcaataatcattcaagccacagatgggggaggactttttggaaaatctacagtcagaattcaggtgatggatgtaaacgacaacgctcctgaaatcactgtgtcatcaattaccagtccaatcccagaaaacactccagagactgtggttatggttttcaggatacgagacagagactctggggacaacggaaagatggtttgttctatcccggaggacatcccattcgtgctaaaatcttcggtaaataattactacactttggaaacagagagaccgctggacagagagagcagagccgagtacaacatcaccatcaccgtcaccgacttggggacccccaggctaaaaaccgagcacaacataaccgtgctggtctccgacgtcaatgacaacgcccccgccttcacccaaacttcctacgccctgttcgtccgcgagaacaacagccccgccctgcacatcggcagcatcagcgccacagacagagactcgggcaccaacgcccaggtcaactactcgctgctgccgtcccaggacccgcacctgcccctcgcctccctggtctccatcaacgcggacaacggccacctgtttgccctcaggtcgctggactacgaggccctgcaggggttccagttccgcgtgggcgccacagaccacggctccccggctttgagcagcgaggcgctggtgcgcgtgctggtgctggacgccaacgacaactcgcccttcgtgctgtacccgctgcagaacggctccgcgccctgcaccgagctggtgccctgggcggccgagccgggctacctggtgaccaaggtggtggcggtggacggtgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccggcccaggcccaggccgactcgctcactgtctacctggtggtggcgttggcctcagtgtcgtcgctcttcctcttctcggtgctcctgttcgtggcggtgcggctgtgcaggaggagcagggcggccccggtcggtcgctgctcggtgcctgagggcccctttccaggacatctggtggacgtgagtggcaccgggaccctgtcccagagctaccactatgaggtgtgtgtgactggaggctccaggtcaaataagttcaaatttctgaaaccaattatccccaacttcctaccccagagcacaggtagtgaagtcgaagaaaatcccccatttcagaataatttgggtttctgataaagaatgaaaaataaaacctgtgtttatgaatacatttataattaggaacttatcgtgaggtgcctgtaaagtagtatttttgatcacttcaaatacatactcttcaagtcaagaaataaatttctttacatagaaaaggatacagatttagtaccaagaacacttcacaaagcaggaaatgtgcatgtgtaatggtttatgtcaaacaattatgcttaatataaagtctattaagtggt

SEQ ID NO: 24877 - DNA, 3485 bp, Homo sapiens
aaaaagcagcagaacctggaagtccacggggagcttggatgccaaagggaggacggctgggtcctctggagaggactactcactggcatatttctgaggtatctgtagaataaccacagcctcagatactggggactttacagtcccacagaaccgtcctcccaggaagctgaatccagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactacgtttcctctgaagaatgccgaagacttagatgtaggccaaaacaatattgagaactatataatcagccccaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacatcgaagtcctggatgtcaacgataatgcccctgaatttgagcagcctttctatagagtgcagatctctgaggacagtccggtaggcttcctggttgtgaaggtctctgccacggatgtagacacaggagtcaacggagagatttcctattcacttttccaagcttcagaagagattggcaaaacctttaagatcaatcccttgacaggagaaattgaactaaaaaaacaactcgatttcgaaaaacttcagtcctatgaagtcaatattgaggcaagagatgctggaaccttttctggaaaatgcaccgttctgattcaagtgatagatgtgaacgaccatgccccagaagttaccatgtctgcatttaccagcccaatacctgagaacgcgcctgaaactgtggttgcacttttcagtgtttcagatcttgattcaggagaaaatgggaaaattagttgctccattcaggaggatctacccttcctcctgaaatccgcggaaaacttttacaccctactaacggagagaccactagacagagaaagcagagcggaatacaacatcactatcactgtcactgacttggggacccctatgctgataacacagctcaatatgaccgtgctgatcgccgatgtcaatgacaacgctcccgccttcacccaaacctcctacaccctgttcgtccgcgagaacaacagccccgccctgcacatccgcagcgtcagcgctacagacagagactcaggcaccaacgcccaggtcacctactcgctgctgccgccccaggacccgcacctgcccctcacatccctggtctccatcaacgcggacaacggccacctgttcgccctcaggtctctggactacgaggccctgcaggggttccagttccgcgtgggcgcttcagaccacggctccccggcgctgagcagcgaggcgctggtgcgcgtggtggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccgacccaggcccaggccgacttgctcaccgtctacctggtggtggcgttggcctcggtgtcttcgctcttcctcttttcggtgctcctgttcgtggcggtgcggctgtgtaggaggagcagggcggcctcggtgggtcgctgcttggtgcccgagggcccccttccagggcatcttgtggacatgagcggcaccaggaccctatcccagagctaccagtatgaggtgtgtctggcaggaggctcagggaccaatgagttcaagttcctgaagccgattatccccaacttccctccccagtgccctgggaaagaaatacaaggaaattctaccttccccaataactttgggttcaatattcagtgaccatagttgacttttacattccataggtattttattttgtggcatttccatgccaatgtttatttcccccaatttgtgtgtatgtaatattgtacggatttactcttgatttttctcatgttctttctccctttgttttaaagtgaacatttacctttattcctggttcttaaaaggtgacaattcattctttaacccagatggtcttaatttgtaattaatttgcctccctaaagagcaataccaaatcacatttttttcatgcccctatctttagctgaacttcacccactattatgcttatggtaaaattaaatagagcaatttggaagtgattccaattttccagcatttcttcatttgattctctttttttagtcttaaaataatgactcctattcagacatatcatttttcttttttgtaaatccagtgcgtttttagttaacctttaaatatgctttttgctttcaaaaataaaccagaaaacctatatcctatgatacaactctaagtgttatcacttgattcgaaagggtcagaagaccagttttttagtatcctttcctcattcatcctggagaggattgtgcaggcacattaatattgtgaccaatcacagaatctgggaatatgaagctataattttttaattaatgtcacaaagctctagtgcaatctagttgaatgcagatgcctgtgcccaaataataattcatatagcataaattggagttgtgtgttaatgtgtaaaaatttttgcctgtactatcatataatttaatgtatatacaccagaaactatttttcaaactttttttactgcaaccaatagttaagattatattttacatattttgaaacacacaagcttaatagaaataaatgcttgtgaacaatg

SEQ ID NO: 24878 - DNA, 2235 bp, Homo sapiens
atggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactacgtttcctctgaagaatgccgaagacttagatgtaggccaaaacaatattgagaactatataatcagccccaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacatcgaagtcctggatgtcaacgataatgcccctgaatttgagcagcctttctatagagtgcagatctctgaggacagtccggtaggcttcctggttgtgaaggtctctgccacggatgtagacacaggagtcaacggagagatttcctattcacttttccaagcttcagaagagattggcaaaacctttaagatcaatcccttgacaggagaaattgaactaaaaaaacaactcgatttcgaaaaacttcagtcctatgaagtcaatattgaggcaagagatgctggaaccttttctggaaaatgcaccgttctgattcaagtgatagatgtgaacgaccatgccccagaagttaccatgtctgcatttaccagcccaatacctgagaacgcgcctgaaactgtggttgcacttttcagtgtttcagatcttgattcaggagaaaatgggaaaattagttgctccattcaggaggatctacccttcctcctgaaatccgcggaaaacttttacaccctactaacggagagaccactagacagagaaagcagagcggaatacaacatcactatcactgtcactgacttggggacccctatgctgataacacagctcaatatgaccgtgctgatcgccgatgtcaatgacaacgctcccgccttcacccaaacctcctacaccctgttcgtccgcgagaacaacagccccgccctgcacatccgcagcgtcagcgctacagacagagactcaggcaccaacgcccaggtcacctactcgctgctgccgccccgcgtggtggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccgacccaggcccaggccgacttgctcaccgtctacctggtggtggcgttggcctcggtgtcttcgctcttcctcttttcggtgctcctgttcgtggcggtgcggctgtgtaggaggagcagggcggcctcggtgggtcgctgcttggtgcccgagggcccccttccagggcatcttgtggacatgagcggcaccaggaccctatcccagagctaccagtatgaggtgtgtctggcaggaggctcagggaccaatgagttcaagttcctgaagccgattatccccaacttccctccccagtgccctgggaaagaaatacaaggaaattctaccttccccaataactttgggttcaatattcagtga

SEQ ID NO: 24879 - DNA, 2802 bp, Homo sapiens
aagtccacggggagcttggatgccaaagggaggacggctgggtcctctggagaggactactcactggcatatttctgaggtatctgtagaataaccacagcctcagatactggggactttacagtcccacagaaccgtcctcccaggaagctgaatccagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactacgtttcctctgaagaatgccgaagacttagatgtaggccaaaacaatattgagaactatataatcagccccaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacatcgaagtcctggatgtcaacgataatgcccctgaatttgagcagcctttctatagagtgcagatctctgaggacagtccggtaggcttcctggttgtgaaggtctctgccacggatgtagacacaggagtcaacggagagatttcctattcacttttccaagcttcagaagagattggcaaaacctttaagatcaatcccttgacaggagaaattgaactaaaaaaacaactcgatttcgaaaaacttcagtcctatgaagtcaatattgaggcaagagatgctggaaccttttctggaaaatgcaccgttctgattcaagtgatagatgtgaacgaccatgccccagaagttaccatgtctgcatttaccagcccaatacctgagaacgcgcctgaaactgtggttgcacttttcagtgtttcagatcttgattcaggagaaaatgggaaaattagttgctccattcaggaggatctacccttcctcctgaaatccgcggaaaacttttacaccctactaacggagagaccactagacagagaaagcagagcggaatacaacatcactatcactgtcactgacttggggacccctatgctgataacacagctcaatatgaccgtgctgatcgccgatgtcaatgacaacgctcccgccttcacccaaacctcctacaccctgttcgtccgcgagaacaacagccccgccctgcacatccgcagcgtcagcgctacagacagagactcaggcaccaacgcccaggtcacctactcgctgctgccgccccaggacccgcacctgcccctcacatccctggtctccatcaacgcggacaacggccacctgttcgccctcaggtctctggactacgaggccctgcaggggttccagttccgcgtgggcgcttcagaccacggctccccggcgctgagcagcgaggcgctggtgcgcgtggtggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccgacccaggcccaggccgacttgctcaccgtctacctggtggtggcgttggcctcggtgtcttcgctcttcctcttttcggtgctcctgttcgtggcggtgcggctgtgtaggaggagcagggcggcctcggtgggtcgctgcttggtgcccgagggcccccttccagggcatcttgtggacatgagcggcaccaggaccctatcccagagctaccagtatgaggtgtgtctggcaggaggctcagggaccaatgagttcaagttcctgaagccgattatccccaacttccctccccagtgccctgggaaagaaatacaaggaaattctaccttccccaatttgtgtgtatgtaatattgtacggatttactcttgatttttctcatgttctttctccctttgttttaaagtgaacatttacctttattcctggttcttaaaaggtgacaattcattctttaacccagatggtcttaatttgtaattaatttgcctccctaaagagcaataccaaatcacatttttttcatgcccctatctttagctgaacttcacccactattatgcttatggtaaaattaaatagagcaatttggaagtg

SEQ ID NO: 24880 - DNA, 2781 bp, Homo sapiens
atggagatcagaggggcactcgatctgcgaaaaaggcaagttctaatattccttgttttgctgggattgtctcgggcaggtactgaatctgcacactattctgtggcagaggaaacagaaattggctcttttgtggctaatctagcgagggacctagggctgggggtggaggagctgtcttcacgtgaagcccgggtagtgtctgatgataataaaaagtatttgcaccttgatttgctgactgggaatttgctcctaaatgagaaactagaccgagacgagctgtgtggctccaccgagccctgtgtgctgcattttcaggtggttttggaaaaccctttacagttttttcggtttgagctgtgtgtcaaagacataaatgatcactcccctacatttctagacaaggaaatacttattaaaatatcagaaggtaccactgttggagctacctttctaatggagagtgctcaagatttggatgtcggaagcaacagtctccaaaactacacaattagccccaattctcacttctacattaaaattcccgacagtagtgacagaaagatatacccagagctggtcctagatagagctttagattatgaacaggaagctgaactcagattaacactcacagcagtggatggtggatccccgcccaagtctgggacaactttggttctcatcaaggtgttggacatcaatgataatgcccctgagtttcctcagagtctctatgaggtgcaagtccccgaggacagaccccttggctcctggattgccaccatctcagctaaggatctggatgcaggaaactatggaaaaatatcttacacatttttccatgcatcagaagatattcgtaaaacatttgaaattaatccaatatctggggaagttaatttgagatcacccctggattttgaagtaatacagtcctacactataaatattcaggcaacagatggtgggggtctttcaggaaaatgcacccttctagttaaagttatggatataaacgacaacccaccagaagtgaccatatcgtcgattacaaagagaattccagagaatgcctcagagaccctagtagctctttttagtatcctagaccaagactctggagacaatgggaggatgatttgctctattcaagataacctcccttttttcctgaaaccgaccttcaagaactttttcactctagtttctgaaaaagcactggacagagagagccaagccgagtacaacatcacgatcaccgtcacagacttggggacacccaggctgaaaaccgagtacaacataaccgtgctgctctctgacgtcaatgacaacgcccccaccttcacccaaacctcctacaccctgttcgtccgcgagaacaacagccccgccctgcacatcggcagcgtcagcgccacagacagagactcaggcaccaacgcccaggtcaactactcgctgctgccgccccaggaccggcacctgcccctcgcctccttggtctccatcaacgcggacaatggccacctgtttgccctcaggtcgctggactacgaggccctacaggagttcgagtttcgcgtgggcgccacagaccgcgggtccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagcgagcgcgacgcggccaagcacaggctggtggtgctggtcaaggacaatggcgagcctcctcgctcggccaccgccacgctgcacgtgctcctggtggacggcttctcccagccctacctgccgctccctgaggcggccccggcccaggcccaggccgactccctcaccgtctacctggtggtggcattggcctcggtgtcgtcgctcttcctcttctcggtgctcctgttcgtggcggtgcggctgtgcaggaggagcagggcggcctcggtgggtcgctgctcggtgcccgagggtccctttccagggcatctggtggacgtgagcggcaccgggaccctgtcccagagctaccaatacgaggtgtgtctgacaggaggttccgggacaaatgagttcaaatttctgaagccgattatccccaattttcaagttcatgacactggtaggaatatgggggaaatcgagaactttcgaaatagctttggacttaacattcaataaaacaatttattttaaatgtctaatttttggttattcttggcaagctgatggtactttttgcataatcttttgtggattcttggttgtactgtagttgcatgcatgattatagctcttgtttttctcacagtttctttaaaaatctttattagtggctataatgacgtggaaatgtaatctgtgttttctggtttttcatttatttggccaaaatgttatattaatggagttattgctatttttgctgtgataatggtattatgcaagaccatattctcaattatttggatatgcaaactaaagtattaagagctaatgtcattatatatgtaacttaaatctagacaccatcaaagcataaaataaaaataaaaagcgttgctg

SEQ ID NO: 24881 - DNA, 2367 bp, Homo sapiens
actgaaaagacaggcattaaaggagcttcgcctacagagctgctggaggatacactctccagggggttcctgttaaaaaccagagcttcagcttccaaaattacggctgagcttcagtttttccacaagagattgcctaaaggaaccatggagatcagaggggcactcgatctgcgaaaaagacaaggaaatacttattaaaatatcagaaggtaccactgttggagctacctttctaatggagagtgctcaagatttggatgtcggaagcaacagtctccaaaactacacaattagccccaattctcacttctacattaaaattcccgacagtagtgacagaaagatatacccagagctggtcctagatagagctttagattatgaacaggaagctgaactcagattaacactcacagcagtggatggtggatccccgcccaagtctgggacaactttggttctcatcaaggtgttggacatcaatgataatgcccctgagtttcctcagagtctctatgaggtgcaagtccccgaggacagaccccttggctcctggattgccaccatctcagctaaggatctggatgcaggaaactatggaaaaatatcttacacatttttccatgcatcagaagatattcgtaaaacatttgaaattaatccaatatctggggaagttaatttgagatcacccctggattttgaagtaatacagtcctacactataaatattcaggcaacagatggtgggggtctttcaggaaaatgcacccttctagttaaagttatggatataaacgacaacccaccagaagtgaccatatcgtcgattacaaagagaattccagagaatgcctcagagaccctagtagctctttttagtatcctagaccaagactctggagacaatgggaggatgatttgctctattcaagataacctcccttttttcctgaaaccgaccttcaagaactttttcactctagtttctgaaaaagcactggacagagagagccaagccgagtacaacatcacgatcaccgtcacagacttggggacacccaggctgaaaaccgagtacaacataaccgtgctgctctctgacgtcaatgacaacgcccccaccttcacccaaacctcctacaccctgttcgtccgcgagaacaacagccccgccctgcacatcggcagcgtcagcgccacagacagagactcaggcaccaacgcccaggtcaactactcgctgctgccgccccaggaccggcacctgcccctcgcctccttggtctccatcaacgcggacaatggccacctgtttgccctcaggtcgctggactacgaggccctacaggagttcgagtttcgcgtgggcgccacagaccgcgggtccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagcgagcgcgacgcggccaagcacaggctggtggtgctggtcaaggacaatggcgagcctcctcgctcggccaccgccacgctgcacgtgctcctggtggacggcttctcccagccctacctgccgctccctgaggcggccccggcccaggcccaggccgactccctcaccgtctacctggtggtggcattggcctcggtgtcgtcgctcttcctcttctcggtgctcctgttcgtggcggtgcggctgtgcaggaggagcagggcggcctcggtgggtcgctgctcggtgcccgagggtccctttccagggcatctggtggacgtgagcggcaccgggaccctgtcccagagctaccaatacgaggtgtgtctgacaggaggttccgggacaaatgagttcaaatttctgaagccgattatccccaattttcaagttcatgacactggtaggaatatgggggaaatcgagaactttcgaaatagctttggacttaacattcaataaaacaatttattttaaatgtctaatttttggttattcttggcaagctgatggtactttttgcataatcttttgtggattcttggttgtactgtagttgcatgcatgattatagctcttgtttttctcacagtttctttaaaaatctttattagtggctataatgacgtggaaatgtaatctgtgttttctgg

SEQ ID NO: 24882 - DNA, 2653 bp, Homo sapiens
atggagcctgcaggggagcgctttcccgaacaaaggcaagtcctgattctccttcttttactggaagtgactctggcaggctgggaaccccgtcgctattctgtgatggaggaaacagagagaggttcttttgtagccaacctggccaatgacctagggctgggagtgggggagctagccgagcggggagcccgggtagtttctgaggataacgaacaaggcttgcagcttgatctgcagaccgggcagttgatattaaatgagaagctggaccgggagaagctgtgtggccctactgagccctgtataatgcatttccaagtgttactgaaaaaacctttggaagtatttcgagctgaactactagtgacagacataaacgatcattctcctgagtttcctgaaagagaaatgaccctgaaaatcccagaaactagctcccttgggactgtgtttcctctgaaaaaagctcgggacttggacgtgggcagcaataatgttcaaaactacaatatttctcccaattctcatttccatgtttccactcgcacccgaggggatggcaggaaatacccagagctggtgctggacacagaactggatcgcgaggagcaggccgagctcagattaaccttgacagcggtggacggtggctctccaccccgatctggcaccgtccagatcctcatcttggtcttggacgccaatgacaatgccccggagtttgtgcaggcgctctacgaggtgcaggtcccagagaacagcccagtaggctccctagttgtcaaggtctctgctagggatttagacactgggacaaatggagagatatcatactccctttattacagctctcaggagatagacaaaccttttgagctaagcagcctttcaggagaaattcgactaattaaaaaactagattttgagacaatgtcttcgtatgatctagatatagaggcatctgatggcgggggactttctggaaaatgctctgtctctgttaaggtgctggatgttaacgataacttcccggaactaagtatttcatcacttaccagccctattcccgagaattctccagagacagaagtggccctgtttaggattagagaccgagactctggggaaaatggaaaaatgatttgctcaattcaggatgatgttccttttaagctaaaaccttctgttgagaatttctacaggctggtaacagaaggggcgctggacagagagaccagagccgagtacaacatcaccatcaccatcacagacttggggactccaaggctgaaaaccgagcagagcataaccgtgctggtgtcggacgtcaatgacaacgcccccgccttcacccaaacctcctacaccctgttcgtccgcgagaacaacagccccgccctgcacatcggcagtgtcagcgccacagacagagactcgggcaccaacgcccaggtcacctactcgctgctgccgccccgggacccgcacctgcccctcacctccctggtctccattaacacggacaacggccacctgttcgctctccagtcgctggactacgaggccctgcaggctttcgagttccgcgtgggcgccacagaccgcggcttcccggcgctgagcagcgaggcgctggtgcgagtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagcgagcgcgacgtggccaagcacaggctagtggtgctggtcaaggacaatggcgagcctccgcgctcggccaccgccacgctgcaagtgctcctggtggacggcttctctcagccctacctgccgctcccagaggcggccccggcccaagcccaggccgactcgcttaccgtctacctggtggtggcattggcctcggtgtcttcgctcttcctcttctcggtgttcctgttcgtggcagtgcggctgtgcaggaggagcagggcggcctcagtgggtcgctgctcggtgcccgagggcccctttccagggcatctggtggacgtgagcggcaccgggaccctttcccagagctaccagtacgaggtgtgtctgacgggaggctctgaaagtaatgatttcaagttcttgaagcctatattcccaaatattgtaagccaggactctaggaggaaatcagaatttctagaataatgtaggtatctgtagctttccgaccgtctgttaattttgtcttcctcacttttcaccttagttttttttaaccctttagtaatcttgaattctacttttttttaaatttctactgttgtctttagtaatgttactcatttcctttgtctgattgttagttttcaaattattgtattattataaatattttatatcaggaaagttcatatttctgaataaattaatagtattcattcctgaagggtgatatgaaagttaaccccacctaataaacataactctaattctg

SEQ ID NO: 24883 - DNA, 4814 bp, Homo sapiens
caaagctctaagtatgctgggacagatactacaaatgaactttatgatgagcgaattaacctgatttatagtcctgtactttctctacgtgccatatccattattaaagaaatgagtctaagtaggaagtagagttaacctatagtttcatttcttgaatttcttattctctttcttcagtctttttcagttaacctacacacacacacacacacacacacacacacacacacatatgtttataagtgggatgggagaacgggtacggtgataattaaaagaggtaaggtttctcttgagatgaaaatgttctaaaattgtgatggcggatgcacacctctgaatatattaaaagccattgaaatgaaaaaagggtggggggaatccaaaagtgtagcagacccaaccttgagatttgcttgtttgggaatgaattttccaataacttgaaagttgtaaaaactcacacttctcagggttaggtgtcagaaagaaaaggaagtaatttattctttaataaagcaattgttaaatactctttagaactaccactgattgcaattttgcagtgtctactcatagtgtctatataggtaccatgaaaaagatgtacttgtgaaactgttctcatgttacttcagaaaaattttgcttctaagtgtgtattctatgtctggttaaatgttcattgaattttatttaatcattaatctcaacagcattaaacagtcaataacataaatgacagtcttctctttgtactcctccctgtacaacatcacagagctccatctgtatacacgaaagtcacatgaaaatagaactcagtgttttgtattacatagtctattcagtacatttagaagtattttgcctccaatattcaaccacagtaaaagactcagtgagaacgcgtggtggcgctgcaggttaagatgacggaaaatacaactgcctacgcagctccaggatccagcaaaccgtttcccaaagcctggaagcaaaagaatagctgagccagagcgaacgtgagtgtgaaacctctttaagacaccgttgggctgcttggttctgacattctggactgcaaaacagttctactaggatcctggggatacatgaagcttctgtgaaccaacttttcaagaaaaagcaatggagattggatggatgcacaatcggagacaaaggcaagtccttgttttctttgttttgctgagcttgtctggggcgggcgccgagttggggtcctattccgtagtggaagaaacggagagaggctcttttgtggcaaatctaggaaaagacctggggttggggttgacagagatgtccacccgcaaggccaggatcatttcccaggggaacaaacagcatttgcagctcaaggctcaaactggggatttgctcataaatgagaagctagatcgagaggagctatgcggtcccactgagccttgcatactacatttccaagtgttaatggaaaaccctttagaaatatttcaggctgaactgagggtgatagatataaatgaccattctcccatgttcactgaaaaggaaatgattctaaaaataccggaaaacagtcctctaggaactgagttccctctgaatcatgctttggacttggacgtaggaagcaataatgttcaaaactataaaatcagcccaagctctcatttccgggttctaatccatgaattcagagatggcaggaaataccctgagctagtgttggataaagagctggatcgggaggaggagcctcaactaagattaaccctgacagcgctggatggtggctctccaccgcgatctggaactgctcaggtccgtattgaagtggtggacatcaatgataacgctcctgagtttgagcagcccatctacaaagtgcagattccagagaacagtcctcttggctccctggttgccaccgtctccgccagggatttagacggcggagccaatggaaaaatatcatacacactctttcagccttcggaggatattagtaaaactttggaggtaaatcctatgacaggggaagttcgactgagaaagcaagtagatttcgaaatggttacgtcttatgaagtgcgcatcaaagccacagatgggggaggtctttcaggaaagtgcactcttctcctgcaggtggtggacgtgaatgacaatcccccacaggtgaccatgtctgcactcaccagccccatcccagagaactcgcctgagatagtagttgctgttttcagcgtttcagatcctgactccggaaacaatgggaagacgatttcctccatccaggaagaccttccctttcttctaaaaccttcagtcaagaacttttacaccttggtaacggagagagcactcgacagagaagcaagagctgaatataatatcaccctcaccgtcacagatatggggactccaaggctgaaaacggagcacaacataacagtgcagatatcagatgtcaatgataacgcccccactttcacccaaacctcctacaccctgttcgtccgcgagaacaacagccccgccctgcacatcggcagcgtcagcgccacagacagagactcaggcaccaacgcccaggtcacctactcgctgctgccgccccaggacccgcacctgcccctcgcctccctggtctccatcaacgcagacaacggccacctgttcgccctcaggtcgctggactacgaggccctgcgggagttcgagttccgcgtgagcgccacagaccgcggctccccggctttgagcagcgaggcgctggtgcgcgtgctggtgctggacgccaacgacaactcgcccttcgtgctgtacccgctgcagaacggctccgcgccctgcactgagctggtgccccgggcggccgagccgggctacctggtgaccaaggtggtggcggtggacggcgactcgggccagaatgcctggctgtcgtaccagctgctcaaggccacggagcccgggctgttcggtgtgtgggcgcacaatggcgaggtgcgcaccgccaggctgctgagcgagcgcgacgcagccaagcagaggctggtggtgctggtcaaggacaatggcgagcctccgcgctcggccaccgccacgctgcacgtgctcctggtggacggcttctcccagcccttcctgccgctcccagaggcggcccccggccagacccaggccaactcgctcactgtctacctggtggtggcgttggcctcggtgtcgtcgctcttcctcttttcggtgctcctgttcgtggcggtgcggctgtgcaggaggagcagggcggcctcggtgggccgctgctcgatgcctgagggcccctttccagggcgtctggtggacgtaagcggcaccgggaccctgtcccagagctaccaatacgaggtgtgtctgacaggaggctcagaaacaagtgagttcaagttcctgaagccgattatccccaacttctctccttagggcactaggaaagaaatagattaaaattccacccttcacaatagctttggatttaattattgataggaacccatttgataaattccttaacttcttatgattgtcttgttgattaaattgttcatgctcaccaccaccaataaggtatttttctctgattgttagttcaaattatattgttaattccagtttcccttttcctcatatttaccccgaagaggtgttgcatatagaatcccaattaacaaaatatactttatcttcaaagttgatgtcatttaaaatttttccgtctttatattttatttacttcctattcattttttgctccatttttcatgttacttctcagtttcctagaacttcaagtattaaaataacctgttgcatgtattaggcatatttcctatgttacatttcttttgtctattttcctttcaaaattggtatttttgttgggctcaattttcattataatacttttcttaaagtttctttctttcttttcttttctttctttttttttttttcctttttgagacagggtcttactcttgtcacccaggctggagtgcagtggcacaatcttggctcactgcaacctctgcctcctgggctcaacggatccttccacctcagcctcccaagtagcttggactataggtgcatgccaccatgcctggctaatcttttgcagcgatgagattttgccaagttgcccaggctgatcttgaactcctgggctcaagccatcctccctcctcagcctcccaaaattctgggattacaggcataagccaatgtgcccatccaaagttttatttatttatttttttgagatggagtctcgtaaagttacctttaaaaaaaaagttctattttccctgtattggtatctccttaaataaaataaaatattcctattgtaagtgatatgagaaatctttaaccagccttatctaaaaataaaaagagaagccattgtaagacattcagtatgtgtaaatgtgtttgtgtttgtagacaaaaggcaaaggtattatgtaaaaatatttaataatttattctttctattactgaattaaaaaatcagaggtccctgttatatttttaatggctaacaactcaatctcattaagttggaaaaaaaacttatcaaagagacatttacatggtttggcttttatattcatcatagtatacattggcggtatctagccctttctctgtaaaatatccctatgtttaatctgtatttcttgcttattatatgtaaagttgagcttctttctagatattaggcctttgaataaaattctatgtgagtc

SEQ ID NO: 24884 - DNA, 2736 bp, Homo sapiens
ggaagaggaggctttctaaggcggtcgctccgggaaatccgggccctaggattgtccactcatcccagtatcagcgagatacggggagatagagttagcgacaacgtgagccagagctggagcacgtttggtgagagaccagaaagcaatggaggccggagaggggaaggagcgcgttccgaaacaaaggcaagtcctgatattctttgttttgctgggcatagctcaggctagttgccagcctaggcactattcagtggccgaggaaacggagagtggctcctttgtggccaatttgttaaaagacctggggctggagataggagaacttgctgtgaggggggccagggtcgtttccaaaggaaaaaaaatgcatttgcagttcgataggcagaccggggatttgttgttaaatgagaaattggaccgggaggagctgtgcggccccacagagccctgtgtcctacctttccaggtgttactagaaaatcccttgcagttttttcaggcggagctacggattagggacgtaaatgatcattccccagttttcctagacaaagaaatacttttgaaaattccagaaagtatcactcctggaactactttcttaatagaacgtgcccaggacttggatgtaggaaccaacagtctccaaaattacacaatcagtcccaatttccactttcatcttaatttacaagacagtctcgatggcataatattaccacagctggtgctgaacagagccctggatcgcgaggagcagcctgagatcaggttaaccctcacagcgctagatggcgggagtccacccaggtccggcacggccctggtacggattgaagttgtggacatcaatgacaacgtcccagagtttgcaaagctgctctatgaggtgcagatcccggaggacagccccgttggatcccaggttgccatcgtctctgccagggatttagacattggaactaatggagaaatatcttatgcattttcccaagcatctgaagacattcgcaaaacgtttcgattaagtgcaaaatcgggagaactgcttttaagacagaaactggatttcgaatccatccagacatacacagtaaatattcaggcgacagatggtgggggcctatctggaacttgtgtggtatttgtccaagtgatggatttgaatgacaatcctccggaactaactatgtcgacacttatcaatcagatcccagaaaacttgcaggacaccctcattgctgtattcagcgtttcagatcctgactccggagacaacggaaggatggtgtgctccatccaagatgatcttccttttttcttgaaaccttctgttgagaacttttacactctggtgataagcacggccctggaccgggagaccagatccgaatacaacatcaccatcaccgtcaccgacttcgggacacccaggctgaaaaccgagcacaacataaccgtgctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaggacccgcacctgcccctcgcctccctggtctccatcaacgcggacaacggccacctgttcgctctccagtcgctggactacgaggccctgcaggcgttcgagttccgcgtgggcgccgcagaccgcggctccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagggagcgcgacgctgccaagcagaggctggtggtgctggtcaaggacaatggcgagcctccgcgctcggccaccgccacgctgcacgtgctcctggtggacggcttctcccagccctacctgctgctcccggaggcggcaccggcccaggcccaggccgacttgctcaccgtctacctggtggtggcgttggcctcggtgtcttcgctcttcctcttctcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggaggctccgggacaaatgagttcaagttcctgaagccaattatccccaacttcgttgctcagggtgcagagagggttagcgaggcaaatcccagtttcaggaagagctttgaattcacttaagtgttaataaggatctactgaggctagtctcgtttaatttgtggaaagtccttttttactgctttgcccattggaggtgtctccttttattagaaagtaaccatcttattccaattctatgcatgttactggtatttataaatgtatgagtttttttgcggtataataaatgtaaattttctttgtattct

SEQ ID NO: 24885 - DNA, 3173 bp, Homo sapiens
atggaggcgggaggagagcgatttcttagacaaaggcaagtcttgcttctctttgtttttctgggagggtctctggctgggtccgagtcaagacgctattctgtggctgaggaaaaagagaagggctttttaatagccaacctagcaaaggatctgggactaagggtagaggaactggccgcgaggggggcccaagttgtgtccaaagggaacaaacagcattttcagctcagtcatcagacaggtgatttgctcctgaatgagaaattggaccgggaggagctatgcggccccacagaaccatgcatactacattttcagatattactgcaaaaccctttgcaattcgttacaaacgagctccgtatcatagatgtaaatgaccattctccggtattctttgaaaatgaaatgcatctgaaaatcctagaaagcactctgccaggaacagtaattcctttgggaaatgctgaggacttggatgtgggaagaaacagcctccaaaactacactatcactccgaattcccacttccacgtactcactcgcagtcgtagggacggaaggaagtacccggaactagtactggataaagcgctcgatcgggaggagcagccggaactcagcttaacgctcaccgcgctggacggcggctctccccctcggtctgggacagcccagataaacatccaggtcttagatataaacgacaatgcaccagaatttgcacagccgctctatgaggttgcagttctagagaatacccccgttaactctgtcattgtcactgtctcggcttctgacttagatacaggaagttttgggacaatatcatatgcattttttcatgcttctgaagaaattcgcaaaacttttcagctaaatccaattactggtgatatgcaactggtcaaatatttgaattttgaagcgattaatagttatgaagtcgacatcgaggccaaggatggcggaggcctatccggaaagtctacagtcatagtccaggtggttgatgtcaacgacaacccaccggaactgaccttgtcttcagtaaacagccctattcctgagaactcgggagagactgtactggctgttttcagtgtttctgatctagactctggagacaacggaagagtgatgtgttccattgagaacaatctccccttcttcctgaaaccatctgtagagaatttttacaccctagtgtcagaaggcgcgctggacagagagaccagatccgagtacaacattaccatcactatcactgacctggggacacccaggctgaaaaccaagtacaacataaccgtgctggtctccgacgtcaatgacaacgcccccgccttcacccaaatctcctacaccctgttcgtccgcgagaacaacagccccgccctgcacatcggcagtgtcagcgccacagacagagactcaggcaccaacgcccaggtaacctactcgctgctgccgccccaggacccgcacctgcccctctcttccctggtctccatcaacgcggacaacggccacctgtttgccctcaggtcgctggactacgaggccctgcaggcgttcgagttccgcgtgggcgccacagaccgtggctccccggctttgagcagcgaggcgctggtgcgcgtgctggtgctggacgccaacgacaactcgcccttcgtgctgtacccgctgcagaacggctccgcgccctgcaccgagctggtgccccgggcggctgagccgggctacctggtgaccaaggtggtggcggtggacggcgactcgggccagaacgcctggctgtcgtaccagctgctcaaggccacggagcccgggctgttcggcgtgtgggcgcacaatggcgaagtgcgcaccgccaggctgctgagcgagcgcgacgcggccaagcacaggctggtggtgctggtcaaggacaatggcgagcctccgcgctcggccaccgccacgctgcatgtgctcctggtggacggcttctcccagccctacctgcctctcccggaggcggcaccggcccaggcccaggccgacttgctcaccgtctacctggtggtggcattggcctcggtgtcttcgctcttcctcttttcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggaggctccgggacaaatgagttcaagttcctgaagccaattatccccaacttcgttgctcagggtgcagagagggttagcgaggcaaatcccagtttcaggaagagctttgaattcagttaagtgttaataaggatctactgagcctcgtcttagttaatctgtggaaagtccttttttactgctttgtccattggagaggtcttttttggtctggttcaaggcaagtagcaagaatagagcaaaatatcaaatccagggatggcttaggtttcattaacagtactggaaagtagttgtgtggctctgaatgttttgtatttcaatcgagaatccttagtcgatagaacattttgtttatatattgattctactttttctgtagttaatccttgcatattctcctttcatcctggcttgccaacgcagtcttaattccgccttttttttttctaatggggagcaaaaagaaattcactgtcttttaatagtgatttcaaatagcttattaaaataactccattcaaattttacattataaagcaatgtagagagagttccaaaccaccaattttataatttcccttgttgaatatattcatataatgtgttctataatatgcccaaagcagctttgtctatagttaacaaagttttaaggatagacaagaatgtgttttctttaataaatagtaatatatcatctttttagggatatagtactcaaatgaaagtaatttagttcattttctgtgttgacatttgcaattaatatttcaatattttatgtgcttatattggccaaaatatggacacaaatatagactaatatgggtaattaccctttggtttatctaaagtgtgttcatgatgactgaggaaaaaaattaaacctatgccattta

SEQ ID NO: 24886 - DNA, 3621 bp, Homo sapiens
atgaagaagctagggagaattcatccaaacaggcaagtgttggcctttattttgatggtgttcttgtctcaggttcgcctcgagcctattcgttattctgtgttggaggaaacagagagcggctcctttgtagcccatctggccaaggatctgggcctgggaattggggaactggcctcccggtcagcccgggtgctgtctgacgatgacaagcagcgtttgcagctggatcgtcagactggagatttgcttctgagggagaaactagaccgggaagagctctgtggtcctattgaaccgtgtgtactgcatttccaagtgttcctggaaatgccggtgcaattttttcaaggagaattattgatccaggacataaatgatcactctccaatattccctgaaagggaagtgctcttgaaaatactagaaaatagccagccgggtactctatttccgttgctaatagctgaggatttggatgtgggcagcaatggtcttcaaaaatacacaatcagccccaattctcattttcacattctcactcgaaatcatagtgagggcaagaaatacccagatttggtgcaggacaaaccactggatcgagaggagcagcctgagttcagcttaaccctcgtggcgctggatggtgggtcaccacctaggtctggcacggtcatggttcgaatcctgatcatggacatcaatgacaatgctcctgagtttgtgcacactccatatggggtgcaggtcctggaaaacagccccctagactctccaattgttagggtcttagctagagatatagatgctggaaacttcgggagtgtttcttatggcttattccaagcatcagatgaaattaaacaaactttctcaataaatgaagtcacgggagaaatactgttgaaaaaaaaattggatttcgaaaaaattaaatcttaccatgtagaaattgaggccacagatggaggaggcctttctggaaaaggcactgtagtcatagaggtggtggatgtgaatgacaatcccccagaacttatcatatcttcactcaccagctccatcccagaaaatgctcctgagacggtagtctctatcttccgaattcgagatagagattccggagaaaatggaaagatgatttgctctattccagataatctaccgtttattctaaaaccaactttgaagaatttttacaccctggtaacagagagaccactggaccgagagaccagcgctgagtacaacatcaccatcgccgtcactgacttggggacacccaggctgaaaacccagcagaacataaccgtgcaggtctccgacgtcaatgacaacgcccccgccttcacccaaacctcctacaccctgttcgtccgcgagaacaacagccccgccctgcacatcggcagtgtcagcgccacagacagagactcgggcaccaacgcccaggtcacctactcgctgctgccgccccaggacccgcacctgcccctcgcctccctggtctccatcaacgcagacaacggccacctgttcgccctcaggtcgctggactacgaggccctgcaggcgttcgagttccgcgtgggcgcctcagaccgcggttctccggctttgagcagcgaggcgctggtgcgcgtgctggtgctggacaccaacgacaactcgcccttcgtgctgtacccgctgcagaatggctccgcgccctgcaccgagctggtgccccgggcggccgagccgggctacctggtgaccaaggtggtggcggtggacggcgactcgggccagaacgcctggctgtcgtaccagctgctcaaggccacggagcctgggctgttcggcgtgtgggcgcacaatggcgaggtgcgcaccgccaggctgctgagcgagcgcgacgcagccaagcacaggctcgtggtgcttgtcaaggacaatggcgagcctccgcgctcggccaccgccacgctgcacgtgctcctggtggatggcttctcccagccctacctgcctctccctgaggcggccccggcccaggcccaggccgactctctcaccgtctacctggtggtggcgttggcctcggtgtcgtcgctcttcctcttctcggtgctcctgttcgtggcggtgcggctgtgcaggaggagcagggcggcctcggtgggtcgctgctcggtgcccgagggcccctttccagggcatctggtggacgtaagcggcaccgggaccctgtcccagagctaccagtacgaggtgtgtctgacaggagactctgggactggtgagttcaagttcctgaagccaatatttcctaatctcttggttcaggacaccgggagggaagttaaggaaaaccccaagttcagaaatagcttggtattcagttaagtattgtatttagttcagtgaaccgcccgttagttttgtcaaacttcccactgcaatgcctttatttaaaaaaattgtctacttatctaaatattcataccacaatttcaaacctactcatgtccctgataaagctaaatttgtcccttttttattgttattaattgcacttaacatttttagttatactggatattgagtatggattttctctatatttgatctattggtgattaatctttttgtaatcataaattactcaattaggataaaaataaattatgttttaatgaaattcttaaattaacatctttttaatggaacatttaagtgaatatatgaatattgaatttctaaatatttgttgtgcctgtctttaccatgtaacttaatgtttgcaaggccagagtgtttgaaagttttgtatttaactttataattaccttgtcctttctggttgactatactaggctaagccctcttaatagccatgagtgtaaaatttagtttactcatttttcacaaattgtatataaacatgcacttcactacattggtaatacactaaaattgtggtccttttcctcttgtgaccaccacatgtctagtgattattttgtttatttggttgctacttacctagcacattgtaatgttccatgaatgctaatattaaattttgtaaaaataacttatttataaataatttttaaagagaaaaatctcatataatttgtcataacctttcaataaataaaactgttaaatcatggcctgatatcatcttaaaaaaaaatctcagaatctgaaataagccctaaatttctccccaaaatcaagactcttgagagcatcataggtctccttgtgctaccttttactccctataaatagaaatccaagtatactttaatatgtgtatattttttggttttcctacagcttctccccatctttcaaaagaatcacgaaatttcttctgcaccttggctattctgtttaaatctgataatcagttgatctcaggtttttcactgtacattactttgcagatatggacagcctttacaaaaataatttttaaatgcttaattattttaatttgttctttaaggtaaccttcagttattttgaattaatttaacttctcaattatgccaaagttgcacttgcatgaaataaatattattttgtccttgtatagactggaacagtaataaatttatctgaatt

SEQ ID NO: 24887 - DNA, 2904 bp, Homo sapiens
agtgggctctgcggataactcagacgccattaagctggggaatccaaactctaaaagaaggacgcattttaggtaagatctagtggctagatcttcagggtgggcttcgttcttgtggaaatcagtcaagaaagatcggattcgcggttatttatgcaaatcatctgggtggattgtgtacggagttaaactgcgccttctggaccgggtctgaacaatggagactgcgctagcaaaaacgccacagaaaaggcaagttatgtttcttgctatattgttgcttttgtgggaggctggctctgaggcagttaggtattccataccagaagaaacagaaagtggctattctgtggccaacctggcaaaagacctgggtcttggggtgggggaactggccactcggggcgcgcgaatgcattacaaaggaaacaaagagctcttgcagcttgatataaagaccggcaatttgcttctatatgaaaaactagaccgggaggtgatgtgcggggcgacagaaccctgtatattgcatttccagctcttactagaaaatccagtgcagttttttcaaactgatctgcagctcacagatataaatgaccatgccccagagttcccagagaaggaaatgctcctaaaaatcccagagagcacccagccagggactgtgtttcccttaaaaatagcccaggactttgacataggtagcaacactgttcagaactacacaatcagcccaaattcacactttcatgttgctacgcataatcgcggagatggcagaaaatacccagagctggtgctggacaaagcgctggaccgggaggagcggcctgagctcagcttaacactcactgcactggacggtggggctccgcccaggtccgggaccaccacaattcgcattgtcgtcttggataataatgacaacgcccccgaatttttacaatcattctatgaggtacaggtgcccgagaacagcccccttaactccttagttgtcgttgtctccgctcgagatttagatgcaggagcatatgggagtgtagcctatgctctattccaaggcgatgaagttactcaaccatttgtaatagacgagaaaacagcagaaattcgcctgaaaagggcattggatttcgaggcaactccatattataacgtggaaattgtagccacagatggtgggggcctttcaggaaaatgcactgtggctatagaagtggtggatgtgaatgacaacgcccctgaactcaccatgtctacgctctccagccctaccccagaaaatgccccggaaactgtagttgccgttttcagtgtttctgatccagactccggggacaacggtaggatgatttgctccatccagaatgatctcccctttcttttgaagcccacattaaaaaacttttacaccctagtgacacagagaacactggacagagagagccaagccgagtacaacatcaccatcactgtcaccgacatggggacacccaggctgaaaaccgagcacaacataacggtcctggtctccgacgtcaatgacaacgcccccgccttcacccaaacctcctacaccctgttcgtccgagagaacaacagccccgccctgcacatcggcagtgtcagcgccacagacagagactcaggcaccaacgcccaggtcacctactcgctgctgccgccccagaacccacacctgcgcctcgcctccctggtctccatcaacgcggacaacggccacctgtttgccctcaggtcgctggactacgaggccctgcaggcgttcgagttccgcgtgggagccacagaccgcggctccccggcgctgagcagcgaggcgctggtgcgcgtgctggtgctggacgccaacgacaactcgcccttcgtgctgtatccgctgcagaacggctcggcgccttgcaccgagctggtgccccgggcggccgagccgggctacctggtgaccaaggtggtggcggtggacggcgactcgggccagaacgcctggctgtcgtaccagctgctcaaggccacggagcccgggctgttcagcatgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgccgctgccggaggcggccccggcccaggcccaggccgactcgctcactgtctacctggtggtggcattggcctcggtgtcgtcgctcttcctcttttcggtgctcctgttcgtggcagtgcggctgtgcaggaggagcagggcggcctcggtcggtcgctgctcggtgcccgagggcccctttccagggcatctggtggacgtgagcggcaccgggaccctatcccagagctaccactacgaggtgtgtttgaccggagactcaggggccggcgagttcaagttcctgaagccgattattcctaaccttttgccccagggcgctggtgaagaaatagggaaaactgctgccttccggaatagctttggattaaattagagatctcgtgatgacgcgttgttttctgccatttatcccaaactttttcagatctagaattcgagagtgtcatggacaaaaatttcaccttgagattgagcttttatttccctttttaatggatttgtctgttgaacttcatgctgtccaagtgttgaaaagtcaattttatttcattgcatttatttacatagtgtcattccaaatccatgcatgctgttgattttcctgagatttttttctcttcttgttggtatttgttgtgataaaccaccttaataaaatcaagtattaatttt

SEQ ID NO: 24888 - DNA, 1107 bp, Homo sapiens
ggtggggctccgcccaggtccgggaccaccacaattcgcattgtcgtcttggataataatgacaacgcccccgaatttttacaatcattctatgaggtacaggtgcccgagaacagcccccttaactccttagttgtcgttgtctccgctcgagatttagatgcaggagcatatgggagtgtagcctatgctctattccaaggcgatgaagttactcaaccatttgtaatagacgagaaaacagcagaaattcgcctgaaaagggcattggatttcgaggcaactccatattataacgtggaaattgtagccacagatggtgggggcctttcaggaaaatgcactgtggctatagaagtggtggatgtgaatgacaacgcccctgaactcaccatgtctacgctctccagccctaccccagaaaatgccccggaaactgtagttgccgttttcagtgtttctgatccagactccggggacaacggtaggatgatttgctccatccagaatgatctcccctttcttttgaagcccacattaaaaaacttttacaccctagtgacacagagaacactggacagagagagccaagccgagtacaacatcaccatcactgtcaccgacatggggacacccaggctgaaaaccgagcacaacataacggtcctggtctccgacgtcaatgacaacgcccccgccttcacccaaacctcctacaccctgttcgtccgagagaacaacagccccgccctgcacatcggcagtgtcagcgccacagacagagactcaggcaccaacgcccaggtcacctactcgctgctgccgccccagaacccacacctgcgcctcgcctccctggtctccatcaacgcggacaacggccacctgtttgccctcaggtcgctggactacgaggccctgcaggcgttcgagttccgcgtgggagccacagaccgcggctccccggcgctgagcagcgaggcgctggtgcgcgtgctgtgctggacgccaacgacaactcgcccttcgtgctgtatccgctgcagaacggctcggcgccttgcaccgagctggtgccccgggcggccgagccgggctacctggtga

SEQ ID NO: 24889 - DNA, 3030 bp, Homo sapiens
atgatgcaaactaaagtacagaacaagaaaaggcaagtggctttcttcattttattgatgctttggggagaggtgggttctgaatcgattcagtattccgtattggaggagacagaaagtggcacgtttgtggccaacttgacaaaggacctgggactgagggtgggggagctggcttcgcggggcgctcgggttgttttcaaagggaacagacaacatttgcagtttgatccacagacccatgatttactgctaaatgaaaaactggaccgggaggagctgtgtggctccactgagccgtgtgtgctacctttccaagtgttactggaaaaccccttgcagttttttcaggcttccttgcgagtcagagatataaatgaccacgccccggaattccctgccagagaaatgctcctgaaaatatcagaaattactatgccaggaaagatatttcctttgaaaatggcacacgatttagacaccggcagcaacggccttcagaggtacacaatcagctccaaccctcacttccacgttctcacccgcaatcgcagcgaaggcaggaagttcccggagctggtgctagacaaaccgttggaccgcgaggagcagccccaactcaggctaacgctgatcgcgctggatggcgggtctccgccccggtcagggacctccgagattcagatccaggttttggacatcaatgacaacgtccccgagtttgctcaggagctctatgaagcacaagtccctgagaacaaccccctcggctctctggttattaccgtctcagccagagatttagatgcaggatcgtttgggaaggtatcttacgccctgtttcaagtcgatgacgtcaaccaacccttcgaaataaacgcaatcacaggagaaattcggctgagaaaggctttggattttgaggaaattcagtcttatgacgtggatgttgaggctacagatggtggaggcctatcaggaaaatgctctttagtcgtcagggtcctggacgtgaatgacaatgcccctgaactcaccatgtcgttcttcatcagcctcatcccagaaaacttaccagagatcacagtggcagttttcagtgtttcagatgcagactctggacataaccaacaggttatttgttcaatagagaacaatctcccctttctactaagaccttccgtggagaatttctacaccctggtaacagaaggcgcgctggacagagagagcagagccgagtacaacatcactatcacggtcactgatttggggacaccaaggctgaaaacccagcagagcataactgtgcaggtctccgacgtcaatgacaacgtccccgccttcacccaaacctcctacaccctgttcgtccgcgagaacaacagccccgccctgcacatcggcagcgtcagcgccacagacagagactcaggcatcaacgcccaggtcacctactcgctgctgccgccccaggacccgcacctgcccctctcttccctggtctccatcaacgcggacaacggccacctgtttgccctcaggtcgctggactacgaggccctgcagtctttcgagttccgcgtgggcgccacagaccgcggctccccggcgttgagcagcgaggcgctggtgcgcttgctggtgctggacgccaacgacaactcgcccttcgtgttgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgagacgcagccaagcacaggctggtggtgcttgtcaaggacaatggcgagcctccgcgctcggccaccgccacgctgcacgtgctcctggtggacggcttctcccagccctacctgcctctccctgaggcggccccggcccaagcccaggccgactctctcaccgtctacctggtggtggcgttggcctcggtgtcgtcgctcttcctcttttcggtgctcctgttcgtggcggtgcggctgtgcaggaggagcagggcggcctcggtgggtcgctactcggtgcccgagggtccctttccagggcatctggtggatgtgagcggcaccgggaccctatcccagagctaccagtacaaggtgtgtctgacgggaggctcagaaacaaatgagttcaagttcctgaagccgattatgcccaacttccctcctcagggcactgagagagaaatggaagaaacccccacctctcggaatagcttcccgttcagttaagtgtgggattattttactaaatcttacttatgtttggagatctcttttaacttaaagttacatggtctgtttcttgtttattttacctctattctttaggttgaaattttatataaagtaagatactggtatcttagtatttcctgttcatgcttagtagtttattacttcacttgagggtacttgacaatatgaacaaaaagtaaatttttatttgcataattttaagcttttgaaattaaattatctattcttcccccccccaaaaaaaagtattgtaaatccttaagtaaaattgtatttctagctattggtaagagttgtttcactattgctatgtaggactgtttaaaatgtgagtatctgatattatttaatcctccaatgtctcattttgcagtaactcctacagtgtgtaacactaaaaataagaactaatgatggctaaacactaaagtagccattcatacttatgcatattttagtatcccataatagtcaatccaaaatttttgtgactatagactttactgaagtgtcaacacattagtttgtgagcctcatgtaagaacatgatggtctttttttaaaaaaaaagtcgtgccaattataagtgcttaataaatatttgctgaatgttactaa

SEQ ID NO: 24890 - DNA, 1107 bp, Homo sapiens
ggcgggtctccgccccggtcagggacctccgagattcagatccaggttttggacatcaatgacaacgtccccgagtttgctcaggagctctatgaagcacaagtccctgagaacaaccccctcggctctctggttattaccgtctcagccagagatttagatgcaggatcgtttgggaaggtatcttacgccctgtttcaagtcgatgacgtcaaccaacccttcgaaataaacgcaatcacaggagaaattcggctgagaaaggctttggattttgaggaaattcagtcttatgacgtggatgttgaggctacagatggtggaggcctatcaggaaaatgctctttagtcgtcagggtcctggacgtgaatgacaatgcccctgaactcaccatgtcgttcttcatcagcctcatcccagaaaacttaccagagatcacagtggcagttttcagtgtttcagatgcagactctggacataaccaacaggttatttgttcaatagagaacaatctcccctttctactaagaccttccgtggagaatttctacaccctggtaacagaaggcgcgctggacagagagagcagagccgagtacaacatcactatcacggtcactgatttggggacaccaaggctgaaaacccagcagagcataactgtgcaggtctccgacgtcaatgacaacgtccccgccttcacccaaacctcctacaccctgttcgtccgcgagaacaacagccccgccctgcacatcggcagcgtcagcgccacagacagagactcaggcatcaacgcccaggtcacctactcgctgctgccgccccaggacccgcacctgcccctctcttccctggtctccatcaacgcggacaacggccacctgtttgccctcaggtcgctggactacgaggccctgcagtctttcgagttccgcgtgggcgccacagaccgcggctccccggcgttgagcagcgaggcgctggtgcgcttgctgtgctggacgccaacgacaactcgcccttcgtgttgtacccgctgcagaacggctccgcgccctgcaccgagctggtgccccgggcggccgagccgggctacctggtga

SEQ ID NO: 24891 - DNA, 2600 bp, Homo sapiens
aaagctgagatagatgtgtccgggaaggcagtcgtcgccagacaagttgtaagaacgaatttaaaaatctctgcaaagacatccgagagggtcgacggtagatgtggtgattgggagctgaaaaggatttttcttccgtattcagacataatagacatgatgcaaactaaagtacagaacaagaaaagacccatgatttactgctaaatgaaaaactggaccgggaggagctgtgtggctccactgagccgtgtgtgctacctttccaagtgttactggaaaaccccttgcagttttttcaggcttccttgcgagtcagagatataaatgaccacgccccggaattccctgccagagaaatgctcctgaaaatatcagaaattactatgccaggaaagatatttcctttgaaaatggcacacgatttagacaccggcagcaacggccttcagaggtacacaatcagctccaaccctcacttccacgttctcacccgcaatcgcagcgaaggcaggaagttcccggagctggtgctagacaaaccgttggaccgcgaggagcagccccaactcaggctaacgctgatcgcgctggatggcgggtctccgccccggtcagggacctccgagattcagatccaggttttggacatcaatgacaacgtccccgagtttgctcaggagctctatgaagcacaagtccctgagaacaaccccctcggctctctggttattaccgtctcagccagagatttagatgcaggatcgtttgggaaggtatcttacgccctgtttcaagtcgatgacgtcaaccaacccttcgaaataaacgcaatcacaggagaaattcggctgagaaaggctttggattttgaggaaattcagtcttatgacgtggatgttgaggctacagatggtggaggcctatcaggaaaatgctctttagtcgtcagggtcctggacgtgaatgacaatgcccctgaactcaccatgtcgttcttcatcagcctcatcccagaaaacttaccagagatcacagtggcagttttcagtgtttcagatgcagactctggacataaccaacaggttatttgttcaatagagaacaatctcccctttctactaagaccttccgtggagaatttctacaccctggtaacagaaggcgcgctggacagagagagcagagccgagtacaacatcactatcacggtcactgatttggggacaccaaggctgaaaacccagcagagcataactgtgcaggtctccgacgtcaatgacaacgtccccgccttcacccaaacctcctacaccctgttcgtccgcgagaacaacagccccgccctgcacatcggcagcgtcagcgccacagacagagactcaggcatcaacgcccaggtcacctactcgctgctgccgccccaggacccgcacctgcccctctcttccctggtctccatcaacgcggacaacggccacctgtttgccctcaggtcgctggactacgaggccctgcagtctttcgagttccgcgtgggcgccacagaccgcggctccccggcgttgagcagcgaggcgctggtgcgcttgctggtgctggacgccaacgacaactcgcccttcgtgttgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgagacgcagccaagcacaggctggtggtgcttgtcaaggacaatggcgagcctccgcgctcggccaccgccacgctgcacgtgctcctggtggacggcttctcccagccctacctgcctctccctgaggcggccccggcccaagcccaggccgactctctcaccgtctacctggtggtggcgttggcctcggtgtcgtcgctcttcctcttttcggtgctcctgttcgtggcggtgcggctgtgcaggaggagcagggcggcctcggtgggtcgctactcggtgcccgagggtccctttccagggcatctggtggatgtgagcggcaccgggaccctatcccagagctaccagtacaaggtgtgtctgacgggaggctcagaaacaaatgagttcaagttcctgaagccgattatgcccaacttccctcctcagggcactgagagagaaatggaagaaacccccacctctcggaatagcttcccgttcagttaagtgtgggattattttactaaatcttacttatgtttggagatctcttttaacttaaagttacatggtctgtttcttgtttattttacctctattctttaggttgaaattttatataaagtaagatactggtatcttagtatttcctgttcatgcttagtagtttattacttcacttgagggtacttgacaatatgaacaaaaagtaaatttttatttgcataattttaagcttttgaaattaaattatctattcttccccccccc

SEQ ID NO: 24892 - DNA, 3715 bp, Homo sapiens
gaagagaaaagcataggaaaggaaacagtggtaataggaattggggtaaaatgaggatccttccccacaaacattgctattattcagctcatttcaaaggattccgctgctgccatttgtgagagccgctggaggctgagtgaaagtcattttgaaagactgatccaaagaagaatggaggccagagtggagcgtgctgtgcagaaaaggcaagtcttatttctttgtgtatttctgggaatgtcttgggctggcgccgaaccgcttcggtattttgtggcggaggaaaccgagagaggcacctttcttaccaacttggcaaaagacctagggttaggggtaggggaactgagagcccggggaactagaattgtttcagaccagaacatgcaaattttactgctcagttcgcttactggtgatctacttctaaatgagaaattggaccgagaggaactgtgtggccccagagagccctgtgtgctgcctttccagttgttattggaaaaaccttttcagattttccgtgctgaactatgggtcagagacatcaatgatcacgctccagtatttctagacagagagatttccttgaaaatattagaaagtaccactccaggggcggcatttctcctagagagtgcacaggattcagatgttggaaccaacagcctgagtaactacaccatcagccccaatgcctatttccatattaatgtccatgatagcggggaggggaatatctatcccgaattggtgctgaatcaagtgctggatcgggaagagataccagagttcagtttaaccctcaccgctttagacggcggctctcctccaagatcagggaccgccctcgtgcgcattctggttctagacgtaaatgacaacgcccctgattttgtgcggtcgctctacaaggtgcaggtgcccgaaaatagccccgttggttccatggttgtctccgtgtcagccagagatttagataccggaagtaatggggaaatagcctatgcattttcttacgccactgaaagaattctcaaaacgtttcaaatcaatccaacatctggcagtcttcatcttaaagcgcaattggactatgaggcaattcaaacttacacattaactattcaggccaaagacggcggcgggctttctggaaaatgcactgtagtggttgatgtaacagatataaacgataatcgacccgagctgctcctgtcttcacttactagcccaattgcagaaaactcacccgagacagtcgtggctgtttttaggattagagacagagattccgggaacaatggaaagacagtgtgctccatccaggacgatgtccccttcatcctgaagccatctgtcgaaaacttctatactctggtaacagagaaacctttggatcgagagaggaacactgagtacaacatcaccatcaccgtcaccgacttggggacacccaggctgaaaaccgagcacaacataaccgtgctggtctccgacgtcaatgacaacgctcccgccttcacccaaacctcctacaccctgtttgtccgtgagaacaacagccccgccctgcccatcggcagtgtcagcgccacagacagagactcgggcaccaacgcccaggtcatctactccctgctgccgtcccaggacccgcacctgcccctcgcctccctggtctccatcaacgcggacaacggccacctgtttgccctcaggtccctggactacgaggccctgcaggcgttcgagttccgcgtgggcgccacagaccgcggctcccccgcgctgagcagcgaggcgctggtgcgcgtgctggtgctggacgccaacgacaactcgcccttcgtgctgtacccgctgcagaacagctccgcgccctgcaccgagccgttgccccgggcggccgagccgggctacctggtgaccaaggtggtggcggtggacggcgactcgggccagaacgcctggctgtcgtaccagctgctcaaggccacggagcccgggctattcggcgtgtgggcgcacaatggcgaggtgcgtaccgccaggctgctgagcgagcgcgacgcagccaagcagaggctggtggtgctggtcaaggacaatggcgagcctccgcgctcggccaccgccacgctgcacgtgctcctggtggacggcttctcccagccctacctgcggctcccggaggcggccccggaccaggccaactcgctcaccgtctacctggtggtggcgttggcctcggtgtcttcgctcttcctcctctcggtgctcctgttcgtggcggtgcggctgtgcaggaggagcagggcggccccggtgggtcgctgctcggtgcctgagggcccctttccacgacatctggtggacttgagcggcaccgggaccctatcccagagctaccagtatgaggtgtgcctgactggaggctccgggacaaatgagttcaagtttctgaaaccaattatccccaacctgctaccccagagcacaggcagggaagtggaagaaaatcgcccatttcagaataatttgggtttctgataaagaatgtaaactaaatccgcgtctgtgaatacgtttctgattaggaacttattgcgaggttcccttaagggagtgtctttacatcatttcaaatatgtactcttgaagtcaagcaataaatttctatacataaaataggatcctgatttagtatcaagaacccttcacaaagcatgaaatgtatatgtgtaatgttttatgtcaaacaattatgcttaatatacagtctattaaatgtaagtcttgtttgagatattttaaattgctttccattgttttcaatctctactgagacttcctgagttgattagaaagctgtatgagtgtacctaccctagtctcagaagcatagactgtagagtatctttttaagcatttttaaaaaatgcttttaatgcatcatacactattttaacacttttaatctgagaagaagcatatgaggcatggtattttaggaatgaacaaatagatggtcttagagattcagtaagttcactaagttccactaactaataagtgacaaaactgagcatccatcccagatctgtctgactctgggtcagtgaccctgctccgattccatactgttttctgtcattagatatcacctggcaagtttctgcctaattaaggagaagtcttttatcatatttatactgctgtccaatcttttctatatttagaaataataatgtacatatttatctatggttttattttcttatacaccaaaagtcctgcttttctgggtcaattttcaactattattactaatgctctgatctgtccaaactcaagcggaaaacaaaattgaaagggcaacctgtgccttctcctttcttcagaacatatgactttcatttcccagaaaaaagattaatggtcctgagtaggaatattacataattttgattgcatcattagttaattattttcttcatattgtagattttctgcagtcacccatacttaacatttgtaatacattttcctgatttgaaagtttgtttttaaaagttttctattaattatagtgcactattgaatcaggaaaatttaagaaaaagaatagttagttttaaatgcataatatcaaagagaatcatagatgatcattaaatttttagaaattctcggaagttaaggagaagca

SEQ ID NO: 24893 - DNA, 1107 bp, Homo sapiens
ggctctcctccaagatcagggaccgccctcgtgcgcattctggttctagacgtaaatgacaacgcccctgattttgtgcggtcgctctacaaggtgcaggtgcccgaaaatagccccgttggttccatggttgtctccgtgtcagccagagatttagataccggaagtaatggggaaatagcctatgcattttcttacgccactgaaagaattctcaaaacgtttcaaatcaatccaacatctggcagtcttcatcttaaagcgcaattggactatgaggcaattcaaacttacacattaactattcaggccaaagacggcggcgggctttctggaaaatgcactgtagtggttgatgtaacagatataaacgataatcgacccgagctgctcctgtcttcacttactagcccaattgcagaaaactcacccgagacagtcgtggctgtttttaggattagagacagagattccgggaacaatggaaagacagtgtgctccatccaggacgatgtccccttcatcctgaagccatctgtcgaaaacttctatactctggtaacagagaaacctttggatcgagagaggaacactgagtacaacatcaccatcaccgtcaccgacttggggacacccaggctgaaaaccgagcacaacataaccgtgctggtctccgacgtcaatgacaacgctcccgccttcacccaaacctcctacaccctgtttgtccgtgagaacaacagccccgccctgcccatcggcagtgtcagcgccacagacagagactcgggcaccaacgcccaggtcatctactccctgctgccgtcccaggacccgcacctgcccctcgcctccctggtctccatcaacgcggacaacggccacctgtttgccctcaggtccctggactacgaggccctgcaggcgttcgagttccgcgtgggcgccacagaccgcggctcccccgcgctgagcagcgaggcgctggtgcgcgtgctgtgctggacgccaacgacaactcgcccttcgtgctgtacccgctgcagaacagctccgcgccctgcaccgagccgttgccccgggcggccgagccgggctacctggtga

SEQ ID NO: 24894 - DNA, 2711 bp, Homo sapiens
tggcgctgcaggataagaaggcacaaaccagaaccgcagctgcagctccattaaccggcaaaaagcagcagaacctggaagtccacggggagcttggatgccaaagggaggacggctgggtcctctggagaggactactcactggcatatttctgaggtatctgtagaaaaccacagcctcagatactggggactttacagtcccacagaaccgtcctcccaggaagctgaattcagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactgcgtttcctctgaagaatgctgaagacttagatataggccaaaacaatattgagaactatataatcagccccaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacattgaagttgtcgatgtcaatgataatgcccctgaatttgagcagcctttctatagggtgcagatctctgaggacagtccaataagcttcctggttgtgaaggtctctgccacggatgtagacacaggagtcaacggagagatttcctattcacttttccaagcttcagatgagataagcaaaacttttaaggtcgatttcttgacaggagaaattcgactaaagaaacaacttgatttcgaaaaatttcagtcctatgaagtcaatatcgaggcgagagatgctggaggcttttctggaaaatgcaccgttctgattcaagtgatagatgtgaacgaccatgccccagaagttaccatgtctgcatttaccagcccaatacctgagaatgcgcctgaaactgtggttgcacttttcagtgtttcagaccttgattcaggagaaaatgggaaaataagttgctccattcaggaggatctacccttcctcctgaaatcttctgtggggaacttttacaccctactaacagagacaccactagacagagaaagcagagccgagtacaacgtcactatcaccgtcactgacttagggacacccaggctgacaacacatctcaatatgaccgtgctggtgtcggacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaggatccgcacctgcccctcgcctccctggtctccatcaacacagacaacggccacctgttcgccctcaggtcgctggactacgaggccctgcaggcgttcgagttccgggtgggcgcttcagaccgcggctccccggctttgagcagcgaggcgctggtgcgcgtgctggtgctggacgccaacgacaactcgcccttcgtgctgtacccgctgcagaatggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggcgaggtgcgcaccgccaggctgctgagcgagcgcgacgcggccaagcagaggctggtggtgctggtcaaggacaatggcgagcctccgtgctcggccaccgccacgctgcacttgctcctggtggacggcttctcccagccctacctgccgcttccggaggctgccccagcccagggccaggccgactctctcaccgtctacctggtggtggcgttggcctcggtgtcttcgctcttcctcttctcggtgctcctgttcgtggcggtgctgctgtgtaggaggagcagggcggcctcggtgggtcgctgctcagtgcctgagggcccctttccagggcatctggtggacgtgaggggcaccgggagcctgtctcagaactatcagtacgaggtgtgcctggcaggaggctcagggacgaatgagttccagttcctgaaaccagtattacctaatattcagggccattcttttgggccagaaatggaacaaaactctaactttaggaatggctttggtttcagccttcagttaaagtaattgatttcatattatatattttaatttttatgatcaattcaaaggaatggttttctgtca

SEQ ID NO: 24895 - DNA, 2472 bp, Homo sapiens
atgaagattcagaaaaagctgactggctgcagcaggctgatgcttctgtgtctttctctggagctgctgttggaagctggggctgggaatattcactactcagtgccggaagagacagacaaaggttccttcgtaggcaacatcgccaaggacctagggctgcaaccccaggagctggcagatggcggagtccgcatcgtctccagaggtaggatgccgcttttcgctctgaatcctagaagtggcagcttgatcaccgcgcgcaggatagaccgggaggagctctgcgctcagagcatgccgtgtctcgtgagttttaatatccttgttgaggataaaatgaagctttttcctgttgaagtagaaataattgatattaatgacaacactccccaattccagttagaggaactggagtttaaaatgaatgaaataacgactccaggtaccagagtctcattgccttttgggcaagaccttgatgtgggtatgaactcactccagagctaccaactcagctctaaccctcatttctccctggatgtgcaacagggagccgatgggcctcaacatccagagatggtgctgcagagtcccttagacagagaagaagaagctgtccaccacctcatcctcacagcttctgatgggggtgaaccagtccgttcagggaccctcagaatttacattcaggtggtggatgcaaatgacaatcctccagcatttactcaggcacaataccatataaatgtccccgaaaacgtgccgctgggtactcagctgctcatggtaaatgccactgaccctgatgagggagccaatggggaagtaacgtactcctttcacaatgtagaccacagagtggcccaaatatttcgtttagattcttacacaggagaaatatcaaataaagaaccactagatttcgaagaatacaaaatgtattcaatggaagttcaagcccaggatggtgcggggctcatggctaaagttaaggtactgatcaaagttttggatgtaaatgataatgccccagaagtgaccatcacctctgtcaccactgcagttccagaaaactttcctcctgggaccataattgctcttatcagtgtgcatgaccaggactcaggagacaatggctacaccacatgtttcattcctggaaatttaccctttaaattggaaaagttagttgataattattaccgtttagtgactgaaagaacactggacagagaacttatctctgggtacaacatcacaataacagcaatagaccaaggaactccagctctatctactgaaactcacatttcactactagtgacagatatcaatgacaactccccagtcttccatcaggactcctactctgcctacattcccgaaaacaaccccagaggagcctccatcttctctgtgagggcccacgacttggacagcaatgagaatgcacaaatcacttactccctaatagaggacactatccagggggcacccctatctgcctacctctccatcaactccgacactggggtcctgtatgcgctgcgatccttcgactatgagcagttccgggacatgcaactgaaagtgatggcgcgggacagtggggatccgcccctcagcagcaacgtgtctctcagcctattcctgctggaccagaacgacaacgcgcccgagatcctgtaccccgccctccccacagatggttctaccggcgtggagctggcgcccctctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagtctcgtggtggccgtccaggaccacggccagcccccgctctccgccactgtcacgctcaccgtggccgtggccgacaggatctccgacatcctggccgacctgggcagcctcgagccctccgccaaacccaacgattcggacctcactctgtacctggtggtggcggcggccgcggtctcctgcgtcttcctggccttcgtcatcgtgctgctggcgcacaggctgcggcgctggcacaagtcacgtctgctacaggcttcgggaggcggcttagcgagcatgcccggttcgcactttgtgggcgtggacggggttcgggctttcctgcagacctattcccacgaggtctccctcactgcggactcgcggaagagccacctgattttcccccagcccaactatgcggacacactcatcagccaggagagctgtgagaaaaagggttttctatcagcaccccagtctttacttgaagacaaaaaggaaccattttctcaggtaaacttttgtgatgaatgtatcagctatctagagaaaaataattcttga

SEQ ID NO: 24896 - DNA, 4602 bp, Homo sapiens
atgaagattcagaaaaagctgactggctgcagcaggctgatgcttctgtgtctttctctggagctgctgttggaagctggggctgggaatattcactactcagtgccggaagagacagacaaaggttccttcgtaggcaacatcgccaaggacctagggctgcaaccccaggagctggcagatggcggagtccgcatcgtctccagaggtaggatgccgcttttcgctctgaatcctagaagtggcagcttgatcaccgcgcgcaggatagaccgggaggagctctgcgctcagagcatgccgtgtctcgtgagttttaatatccttgttgaggataaaatgaagctttttcctgttgaagtagaaataattgatattaatgacaacactccccaattccagttagaggaactggagtttaaaatgaatgaaataacgactccaggtaccagagtctcattgccttttgggcaagaccttgatgtgggtatgaactcactccagagctaccaactcagctctaaccctcatttctccctggatgtgcaacagggagccgatgggcctcaacatccagagatggtgctgcagagtcccttagacagagaagaagaagctgtccaccacctcatcctcacagcttctgatgggggtgaaccagtccgttcagggaccctcagaatttacattcaggtggtggatgcaaatgacaatcctccagcatttactcaggcacaataccatataaatgtccccgaaaacgtgccgctgggtactcagctgctcatggtaaatgccactgaccctgatgagggagccaatggggaagtaacgtactcctttcacaatgtagaccacagagtggcccaaatatttcgtttagattcttacacaggagaaatatcaaataaagaaccactagatttcgaagaatacaaaatgtattcaatggaagttcaagcccaggatggtgcggggctcatggctaaagttaaggtactgatcaaagttttggatgtaaatgataatgccccagaagtgaccatcacctctgtcaccactgcagttccagaaaactttcctcctgggaccataattgctcttatcagtgtgcatgaccaggactcaggagacaatggctacaccacatgtttcattcctggaaatttaccctttaaattggaaaagttagttgataattattaccgtttagtgactgaaagaacactggacagagaacttatctctgggtacaacatcacaataacagcaatagaccaaggaactccagctctatctactgaaactcacatttcactactagtgacagatatcaatgacaactccccagtcttccatcaggactcctactctgcctacattcccgaaaacaaccccagaggagcctccatcttctctgtgagggcccacgacttggacagcaatgagaatgcacaaatcacttactccctaatagaggacactatccagggggcacccctatctgcctacctctccatcaactccgacactggggtcctgtatgcgctgcgatccttcgactatgagcagttccgggacatgcaactgaaagtgatggcgcgggacagtggggatccgcccctcagcagcaacgtgtctctcagcctattcctgctggaccagaacgacaacgcgcccgagatcctgtaccccgccctccccacagatggttctaccggcgtggagctggcgcccctctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagtctcgtggtggccgtccaggaccacggccagcccccgctctccgccactgtcacgctcaccgtggccgtggccgacaggatctccgacatcctggccgacctgggcagcctcgagccctccgccaaacccaacgattcggacctcactctgtacctggtggtggcggcggccgcggtctcctgcgtcttcctggccttcgtcatcgtgctgctggcgcacaggctgcggcgctggcacaagtcacgtctgctacaggcttcgggaggcggcttagcgagcatgcccggttcgcactttgtgggcgtggacggggttcgggctttcctgcagacctattcccacgaggtctccctcactgcggactcgcggaagagccacctgattttcccccagcccaactatgcggacacactcatcagccaggagagctgtgagaaaaagggttttctatcagcaccccagtctttacttgaagacaaaaaggaaccattttctcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24897 - DNA, 4617 bp, Homo sapiens
atggccgctcaaaggaatcgctcaaaggaatcaaaggattgcagcgggctggtcctgctctgccttttcttcgggattccatgggaggctggagcccggcagatctcctactcaattcctgaggaattagagaaaggctctttcgtgggcaacatctccaaggacttgggtctggcgccccgggagctggcggagcgcggagtccgcatagtctccagaggtaggacgcagcttttctctctgaacccgcgcagcggcagcttgatcaccgcgggcaggatagaccgggaggagctctgcgctcagagcgcgcggtgcgtggtgagttttaatatccttgtggaagacagggtgaaactttttgggatagaaatagaagtaactgatatcaatgacaatgctccaaaattccaagcagaaaatctagacgtaaaaattaatgaaaatgtcgctgcgggaatgcgttttcctctcccggaagctattgatccggatgtgggcgtgaactccctgcagagctatcagctcagccccaataagcacttctccctaagagttcagagccgtgccaatggcgtcaagtacccggagctggtactggagcactccctagatcgcgaggaagaggccattcaccacctggtcctcaccgcctccgacgggggtgaccctctccgatctggcactgtccttgtcagtgtgactgtcttcgatgcaaatgacaacgcgccggtcttcaccttgccagaataccgagtgagtgttcctgagaatttgcctgtgggcactcagctgctgacagtcacagccaccgacagggacgaaggtgccaatggagaagtgacatattcattccgaaaattacctgacacgcaattgttgaagttccaactaaacaaatatactggagaaataaaaatatcagaaaatctagattatgaagaaaccggtttctatgaaatagaaatacaagcagaagatggaggagcatatcttgcaactgcaaaagtgttgattacagtagaagatgtaaatgacaacagtccagagctgaccatcacgtctctatttagtccagtgactgaagattcacctctgggaacagtcgtagcccttttaaatgtgcatgatttagactctgagcagaatggacaggtaacctgttccattttggcgtatctaccatttaaattagaaaagtccattgacagttattacagattggtgatacacagagcccttgacagggaacaggtatcctcttacaatatcacagtgacagccacagatgggggaagtcctcctctatcaacggaagctcactttatgctacaagtggcagatatcaatgacaacccacctaccttctctcaagtctcctactttacctatatcccagagaacaacgccaggggtgcctccatcttctcagtgacagcgctggacccggacagcaaagagaatgcccagattatttactccctggctgaagacaccatccagggggtacctctgtcctcatacatatccatcaactcagacactggcgtcctgtatgcactcagatccttcgactatgagcagtttcatgagctacagatgcaggtgacagccagcgacagcggggatcctccactcagcagcaacgtgtcgttgagcctgtttgtgctggaccagaacgacaatgcgcccgagatcctgtaccccgccctccccacagacggttccacaggcgtggagctggcgccccgctccgcagagcccggctacctggtgaccaaggtggtggcggtggacagagactccggccagaacgcctggctgtcctaccgtctgctcaaggccagcgagccgggactcttcgcggtgggggagcacacgggcgaggtgcgcacggcgcgagccctgctggacagagacgcgctcaagcaaagcctcgtagtggccgtccaggaccacggccagccccctctctccgccactgtcacgctcaccgtggccgtggccgacagcatcccccaagtcctggcggacctcggcagcttcgagtctccagctaactctgaaacctcagacctcactctgtacctggtggtagcggtggccgcggtctcctgcgtcttcctggccttcgtcatcgtgctgctggcgcacaggctgcggcgctggcacaagtcacgcctgctgcaggcttcaggaggcggcttgacaggtgtgtccggctcgcactttgtgggcgtggacggggttcgggctttcctgcagacctattcccacgaggtctctctcaccgcggactcgcgaaagagtcacctgatcttcccccagcccaattatgcggacacgctcatcagccaggagagctgtgagaaaaacgatcctttgtctttgttagatgattcgaagtttcctatagaggataccccattggttccacaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24898 - DNA, 3936 bp, Homo sapiens
gagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggattcacaaactggagaagttcaagtacgggggtctctggattttgaaaaatatagattctatgagatggaaattcaaggccaagatggtggaggtctctttaccaccacgacgatgttgatcactgttgtggatgtgaatgataacgctccagaaataactatcacctcttctattaattcaattctggaaaactctcctccaggtacagtgattgctcttctaaatgtgcaagatcaagattctggagaaaatggtcaagtctcctgttttattcctaaccacctgccttttaaattagaaaagacttatggaaattattacaaattgataacaagcagagtgctggacagggagttggtccagagctacaatataacgttgacagccacagaccagggaagcccgcctttgtctgcagaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcacgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgaggtgcgtacagcgcgggcactgctggacagagacgcgctcaagcagagcctcgtggtggccgtccaggaccacggccagccccctctctcggccaccgtcacgctcaccgtggctgtggccgacagcatccccgaagtcctggcggacctcggcagcctcgagtctctggctaactctgaaacctcagacctctcgctgtacttggtggtggcggtggccgcagtctcctgcatcttcctggtctttgtcatcgtgctgctggcactcaggctgtggcgctggcataagtcacgcctgctgcaggcttctgaaggcgggttggcaggtatgcccacgtcacattttgtaggcgtggacggggtacaggctttcctgcaaacctattcccacgaggtctctctcattgcggactcgcagaagagtcacctgattttcccccagcccaactatggggacacgctcatcagccaggagagctgtgagaaaagcgagccactcttgatagctgaagactcagctatcattttaggcaaatgtgacccgacaagtaatcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccaga

SEQ ID NO: 24899 - DNA, 2260 bp, Homo sapiens
atggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggattcacaaactggagaagttcaagtacgggggtctctggattttgaaaaatatagattctatgagatggaaattcaaggccaagatggtggaggtctctttaccaccacgacgatgttgatcactgttgtggatgtgaatgataacgctccagaaataactatcacctcttctattaattcaattctggaaaactctcctccaggtacagtgattgctcttctaaatgtgcaagatcaagattctggagaaaatggtcaagtctcctgttttattcctaaccacctgccttttaaattagaaaagacttatggaaattattacaaattgataacaagcagagtgctggacagggagttggtccagagctacaatataacgttgacagccacagaccagggaagcccgcctttgtctgcagaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcacgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggag

SEQ ID NO: 24900 - DNA, 4747 bp, Homo sapiens
taggaatgaaccatccctgggagtatgtggaaacaacggaggagctctgacttcccaactgtcccattctatgggcgaaggaactgctcctgacttcagtggttaagggcagaattgaaaataattctggaggaagataagaatgattcctgcgcgactgcaccgggactacaaagggcttgtcctgctgggaatcctcctggggactctgtgggagaccggatgcacccagatacgctattcagttccggaagagctggagaaaggctctagggtgggcgacatctccagggacctggggctggagccccgggagctcgcggagcgcggagtccgcatcatccccagaggtaggacgcagcttttcgccctgaatccgcgcagcggcagcttggtcacggcgggcaggatagaccgggaggagctctgtatgggggccatcaagtgtcaattaaatctagacattctgatggaggataaagtgaaaatatatggagtagaagtagaagtaagggacattaacgacaatgcgccttactttcgtgaaagtgaattagaaataaaaattagtgaaaatgcagccactgagatgcggttccctctaccccacgcctgggatccggatatcgggaagaactctctgcagagctacgagctcagcccgaacactcacttctccctcatcgtgcaaaatggagccgacggtagtaagtaccccgaattggtgctgaaacgcgccctggaccgcgaagaaaaggctgctcaccacctggtccttacggcctccgacgggggcgacccggtgcgcacaggcaccgcgcgcatccgcgtgatggttctggatgcgaacgacaacgcaccagcgtttgctcagcccgagtaccgcgcgagcgttccggagaatctggccttgggcacgcagctgcttgtagtcaacgctaccgaccctgacgaaggagtcaatgcggaagtgaggtattccttccggtatgtggacgacaaggcggcccaagttttcaaactagattgtaattcagggacaatatcaacaataggggagttggaccacgaggagtcaggattctaccagatggaagtgcaagcaatggataatgcaggatattctgcgcgagccaaagtcctgatcactgttctggacgtgaacgacaatgccccagaagtggtcctcacctctctcgccagctcggttcccgaaaactctcccagagggacattaattgcccttttaaatgtaaatgaccaagattctgaggaaaacggacaggtgatctgtttcatccaaggaaatctgccctttaaattagaaaaatcttacggaaattactatagtttagtcacagacatagtcttggatagggaacaggttcctagctacaacatcacagtgaccgccactgaccggggaaccccgcccctatccacggaaactcatatctcgctgaacgtggcagacaccaacgacaacccgccggtcttccctcaggcctcctattccgcttatatcccagagaacaatcccagaggagtttccctcgtctctgtgaccgcccacgaccccgactgtgaagagaacgcccagatcacttattccctggctgagaacaccatccaaggggcaagcctatcgtcctacgtgtccatcaactccgacactggggtactgtatgcgctgagctccttcgactacgagcagttccgagacttgcaagtgaaagtgatggcgcgggacaacgggcacccgcccctcagcagcaacgtgtcgttgagcctgttcgtgctggaccagaacgacaatgcgcccgagatcctgtaccccgccctccccacggacggttccactggcgtggagctggctccccgctccgcagagcccggctacctggtgaccaaggtggtggcggtggacagagactccggccagaacgcctggctgtcctaccgtctgctcaaggccagcgagccgggactcttctcggtgggtctgcacacgggcgaggtgcgcacggcgcgagccctgctggacagagacgcgctcaagcagagcctcgtagtggccgtccaggaccacggccagccccctctctccgccactgtcacgctcaccgtggccgtggccgacagcatcccccaagtcctggcggacctcggcagcctcgagtctccagctaactctgaaacctcagacctcactctgtacctggtggtagcggtggccgcggtctcctgcgtcttcctggccttcgtcatcttgctgctggcgctcaggctgcggcgctggcacaagtcacgcctgctgcaggcttcaggaggcggcttgacaggagcgccggcgtcgcactttgtgggcgtggacggggtgcaggctttcctgcagacctattcccacgaggtttccctcaccacggactcgcggaagagtcacctgatcttcccccagcccaactatgcagacatgctcgtcagccaggagagctttgaaaaaagcgagccccttttgctgtcaggtgattcggtattttctaaagacagtcatgggttaattgagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24901 - DNA, 4605 bp, Homo sapiens
atggcggctctgcaaaagttgccacactgcagaaagctggtcctgctgtgcttccttttggcgaccctgtgggaggccagggccgggcagattcgctattctgtgcgggaagagatcgacagaggctccttcgtaggcaacatcgccaaggacttgggtttggagcccctggcactggcagagcagggagtccgcatcgtctccagaggtaggtcccagctctttgctctgaacccgcgaagcggcagcttggtcactgcgaacaggatagaccgggaggagctctgcgctcagagcgcaccctgtctgttgaattttaacattctgctggaggataaattgactatttattcagtagaggtggaaataacagatattaacgataatgcccctcgctttggagtagaggaactggagctaaaaatcagtgaaaccactacgccaggattccggattcctcttaagaatgcgcatgatgcagacgtaggtgagaacgcccttcagaagtacgcactcaacccaaatgaccacttctccctggacgtgcgaaggggagctgatgggaacaagtacccagaactggtgctggagcgctctctggaccgcgaggaagaggctgttcaccacctcgttctcgtggcttctgatgggggtgacccagtgctatctggcacctcccgcatctgcgtgaaggtcctggatgcgaacgacaatgcgcctgtttttacacagcccgagtaccgcataagcattccggagaatacgctcgtgggcacccggatactcacggtgaccgccactgacgcagatgagggctactacgctcaagtggtatattttctagagaaaagccctggagaaacctcagaggtatttgagcttaagtcaacatctggagaactgacaatcataaaagatctagattatgaggatgctacattccatgaaattgatattgaagctcaggatggtccgggccttctaaccagagcgaaggttatcgtcacggttctggatgtgaatgacaatgccccagaattttacatgacatctgctactagctcagtttctgaagactctcttccaggaaccataattgggctttttaatgtacatgatagagactctgggcagaacgcattcaccacctgttcactccccgaggatcttccttttaagttagaaaagtcagtagacaattactaccgactggttacaaccagagcccttgacagggaacagttttccttttacaacatcactctaaccgctaaagatggagggaacccctccctgtccacggatgctcacattttgctccaggtggcagacatcaacgacaacgcacccgccttctcccgcacatcctactccacctacattcccgaaaacaaccccagaggagcctctgtcttctcagtgacggcccatgaccccgacagcaacgacaatgctcatgtaacttactctttcgcggaggacactgttcagggggcacccttatcctcttacatctctatcaactccgacactggagtactctatgcactgcgctcctttgattatgagcagttgcgagacttgcaagtgtgggtgatagcgcgggacagcgggaaccctccactcagtagcaatgtatcattaagcctgttcgtgctggaccagaacgacaacgcgcccgagatcctgtaccctgccttccccacagacggttccactggcgtggagctggcgccccgctccgcagagcccggctacctggtgaccaaggtggtggcggtggacagagactcgggccagaacgcctggctgtcttaccacctgctcaaggccagcgagccgggactcttctcggtgggtctgcacacgggcgaggtgcgcacggcgcgagccctgctggacagagacgcgctcaagcagagcctcgtggtggccatccaggaccacggccagccccctctctccgccactgtcacgctcaccgtggccgtggccgacaggatccccgacatcctggccgacctgggcagcctcgagccctccgccatacccaacgattcggacctcactctgtacctggtggtggcggtggccgcggtctcctgcgtcttcctggccttcgtcatcgtgttgctggcgcacaggctgcggcgctggcacaagtcacgcctgctgcaggcttcaggaggcagcttgacaggcatgcagagctcgcactttgtgggcgtggacggggttcgggctttcctgcagacctattcccacgaggtctccctcactgcggactcgcggaagagccacctgattttcccccagcccaactatgcggacacgctcatcagccaggagagctgtgagaaaaaggattttttatcagcgcctcaatctctactcgaagaagaaagagaagaaacgttttctcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24902 - DNA, 4605 bp, Homo sapiens
atgaccaattgcctgagtttccgaaatggcagaggactggccctgctgtgcgcgctcctggggacgctgtgcgaaacaggatccggtcagatccgctactcggtgtctgaggagctagataaaggttccttcgtgggcaacatcgctaacgacctggggctagagccccgggagctggcggagcgcggagtccgcatcgtctccagaggtaggacgcagcttttctctctgaatccgcaaagcggcagcttggtcaccgcggagaggatagaccgggaggagctctgcgctcagatcccgctgtgtctggtaaaaattaacattctggttgaggataaattgaaaatttttgaagtagaaatagaaattaaagatattaatgataatgctcctaatttcccaacagaggaattggaaataaaaattggtgaactaacggttcctggaacccgatttccaattaaaactgcttttgacccagatgtaggcattaactccctgcagaactacaagcttagccccaatgactacttctctctggctgtgaatagcgtctctgagggggccaagtatccagagctggtgctggagcgggccctggaccgtgagaaaaaagaaattcaccagcttgtcctggttgcctctgatggtggcgaccctgtccactctggcaacttgcacatccaagtgatagtcctggatgcaaatgacaacccaccaatgtttactcagcctgagtaccgtgtgagtgtttgggagaacgtgcctgtgggtacccggctgctcacggtgaatgccactgaccctgacgagggattcaatgctcaagtgtcttatattctagataaaatgcctgggaaaatcgctgagattttccatcttaactcagtgagtggagaagtatcaatattaaaaagtctagattatgaggatgccatgttctatgaaattaaaattgaagcacaggatggaccaggtcttctttcaagagccaagattctagtcacggttctggatgtgaatgacaatgctccagaaattacaatcacgtctctcacaagctcagtcccagaagagggcaccgttggaagagaaattgctcttatcgacgtgcatgaccgagattctgggcagaatgggcaggttgaagtttttgtcctgggaaatctgccatttaagttagaaaaatcaatagatcaatattaccgcttagtgacggccacatccctggaccgcgaacaaatatcagaatataacattagtctgagagcctcagatgggggaagcccgccactgtccacagaaactcacatcaccctgcatgtgattgacatcaatgacaacccacccaccttccctcatttatcctactccgcctacattccagaaaacaaccccagaggagcctccatcttctcagtgacagcccaggacccagatagcaacaacaacgcccgcatcacttatgcattgaccgaggacactctccagggggcgcccctgtcctccttcgtctctatcaactccaacactggcgtcctatacgcgctgagatccttcgactacgagcaatttagagacttaaagctactggtgacagccagcgacagcgggaaccctccactcagcagcaacgtgtcgctgaacctgttcgtgctggaccagaacgacaacgcgcccgagatcctgtaccccgccctccccacagacggttccactggcgtggagctggcgcctcgctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagcctcgtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcaggctgcggcgctggcacaagtcacgcctgctgcaggcttcgggaggcggcttggcgagtacgcccggctcgcactttgtgggcgcggacggggttcgggctttcctgcagacctattcccacgaggtctccctcactgcggactcgcggaagagccacctgattttcccccagcccaactatgcggacacgctcatcagccaggagagctgtgagaaaagcgagcctcttctgataactcaggatttacttgaaatgaaaggagattccaacctacttcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24903 - DNA, 4602 bp, Homo sapiens
atggcgagtccacctaggggctggggctgcggagagctgctgctgcccttcatgctcctggggacgctgtgcgagccaggatccgggcagatccgctactcgatgccggaggagctggacaaaggctccttcgtcggcaacatagccaaggaccttgggctggagccccaggagctggcggagcgcggagtccgcatcgtctccagaggtaggacgcagctttttgccctgaacccgcgaagcggcagcttggtcaccgcgggcaggatagaccgggaggagctctgcgctcagagcccactgtgtgtggtgaactttaacatcttggttgagaacaaaatgaaaatttatggagtagaagtagaaataatcgatattaatgataacttcccgcgtttccgggatgaagagttaaaagtaaaagttaatgaaaatgcggctgcagggacacggttagtgcttcccttcgcgcgggatgcggatgtgggtgtgaactctctccggagttaccagctcagctccaatctgcacttctctctggatgtggtaagcggaactgatggacaaaagtatccggagctggtgttggaacagcccctagaccgcgagaaagagactgttcacgacctcctcctcacagctttagatggcggagacccggtactctccggcaccacgcacatccgtgttacggtcctcgacgcaaacgacaatgcgcccctgttcaccccatccgagtacagcgtgagtgttccagagaacatacctgtgggcactcggctgctcatgctaaccgccacggatccagatgagggaataaacgggaaattgacctactcttttcgcaatgaagaagaaaaaatttcggagactttccaacttgattccaacctgggggaaatctcaactctacaatcactggactatgaagaatccagattctacctcatggaagtggtagctcaggatggaggcgctcttgttgccagcgctaaggtggtggtcacagtacaggacgtgaatgacaatgcccccgaagtgatcctcacctctctgaccagttcgatctctgaagactgtcttcccggaactgtaatcgcgctgtttagcgtacatgatggtgattctggagaaaatggtgagattgcatgctctattcctaggaatttgccttttaaattggagaagtcagttgataattactatcacctattaacaactagggacctggacagagaagagacttcagattataatatcactttaaccgtcatggaccatggaaccccgcccctctctacagaaagccacatccccttgaaagtagcagacgttaatgacaacccacccaatttccctcaagcctcctactccacctctgtcacagaaaacaatcccagaggtgtctctatcttctctgtgacagcccatgaccccgacagcggcgacaacgctcgagtcacctactccctggctgaagacacatttcagggggcgcccttgtcctcctatgtatccattaactctgacaccggtgtcctgtatgctctgagatccttcgactatgagcagttgagagacctacagttgtgggtgacagccagcgacagtgggaaccctccacttagcagcaacgtgtcgctgagcctgtttgtgctggaccagaacgacaatacgcctgagatcctgtaccccgccctccccacagacggttccacgggcgtggagctggcgcctcgctccgcagaacctggctacctggtgaccaaggtggtagcggtggacaaagattcaggccagaacgcctggctgtcctaccgcctgcttaaggccagcgagccaggactctttgcggttgggctgcacacgggcgaggtgcgcacagcgcgagccctgctggacagagacgcgctcaagcagagcctcgtggtggccgtcgaagaccatggccagccccctctgtcagccaccttcacggtcaccgttgccgtggccgacaggatccctgacatcctggctgacctaggcagtatcaagacccccattgaccctgaggatctggacctcacactctatcttgtggtggcagtggctgcagtctcctgcgtcttcctggccttcgtcatcgtgctgctggtgctcagactgaggcgctggcacaagtcacgcctgcttcaggctgaaggcagcaggttggcgggtgtgcccgcctcgcactttgtgggcgtggatggggttcgggctttcctgcagacctattcccacgaggtctccctcaccgcggactcgaggaagagtcacctgatctttccccagcccaactacgcagacacgctccttagtgaagagagctgtgagaaaagcgagcctcttctgatgtctgataaggtagatgcaaacaaagaagaacggcgagttcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24904 - DNA, 4605 bp, Homo sapiens
atggcgcctccgcagaggcatccgcagcgcagcgagcaggtcctgctcctcacgctcctggggacgctgtggggggccgcggcagcgcagatccgctactctattcccgaggagctggagaaaggctccttcgtaggcaacatcgtcaaggatctgggactggagccccaggagttggcggagcacggagtccgcatcgtctccagaggtaggatgcagcttttctctctgaatccgcgaaacggcagcttggtcaccgcgggtaggatagaccgcgaggagctctgtgctcagagcccgcggtgtctggtgagttttaacatccttgtcgaggataaactgaatctttatcccgtggaagtggaaatagtggacattaatgacaatacaccccgattcttaaaggaagaattggaagtgaaaattctcgaaaacgcagctccatcctctcgttttccactaatggaggtctatgaccctgatgtgggaatgaactcccttcagggatttaagctcagtggtaatagtcacttctcagtggacgtgcaaagcgaagcccatgggcccaagtacccggagctggtgctggagggcacactggaccgggaaggagaagccgtttaccgcctggtccttactgccatggatggcggcgaccctgtccgctcaagcgtcgcccaaattctggtaacagttctagatgtgaatgacaacactccaatgtttactcagcctgtctaccgtgtaagtgttcctgaaaacctgccagtaggcacaccagtgttggcagtgactgccaccgaccaggatgaaggagtccacggggaagtaacttattcctttgtgaagattacagaaaagatctcacaaattttctgtttgaatgttttgactggagaaatttcaacttctgcaaatctagactatgaggactcgagtttttatgagctgggtgttgaagcccgggatgggccaggtcttcgagacagagcgaaagtcttaataactatcttggatgtcaatgataatgtaccagaagtggttgttacatctggaagcagaacaattgctgaaagtgcacctccaggaacagtaatcgccctttttcaagtgttcgatcgagactctggcctgaatggcctggtaacctgttccatcccgagaagtctcccatttgaattggaaaaatcagttggcaattattatcgattagtgacaaatgcagctctagaccgggaagaggtattcttgtacaacatcactgtgacagccacggacaaaggaacaccacctctgtctacagaaacaatcatctctctaaatgtggcagacaccaacgacaacccgcccaccttcccccattcatcctactcagtctatgtccttgaaaacaaccccaggggtgcctccatcttctctgtgaatgcactggaccctgacgtggaccagaacgcccaagtctcctactcactggcagaagacaccctccagggggcgcccctgtcctcctacgtgtccatcaactccgacactgggattctgtacgccctgcgctccttcgactatgagcagttgagagacctacagctgtgggtgacagccagcgacagcggggacccgcctcttagcagcaacgtgtcactgagcctgtttgtgctggaccagaatgacaatgcgcccgagatcctgtaccccgccctccccacagacggttccactggcgtggagctggcgccccgctccgcagagcccggctacctggtgaccaaggtggtggcggtggacagagactcgggccagaacgcctggctgtcctaccgcctgctcaaggccagcgagccaggacttttctcagtgggcctgcacacgggcgaggtgcgcacggcgcgcgccctgctggacagagacgcgctcaagcagagcctagtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcagactgcagcgctggcacaagtcacgcctgctgcaggcttcgggaggtggcttagcgagcatgcccggctcgcactttgtgggcgtggaaggggttcgggctttcctgcagacctattcccacgaggtctcactcactgcagactcgcgtaagagtcatctgattttcccccagcccaactatgccgacacgcttatcaaccaggagagctatgagaaaagcgagcctcttctgataactcaggatttacttgaaacgaaaggagaacccaggcaacttcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24905 - DNA, 4605 bp, Homo sapiens
atggcggctcagccgaggggcggggactacagaggattcttcctgctctccatcctcctggggaccccctgggaagcctgggcaggacgtattctctactccgtgtcggaggagacggacaaagggtcctttgtgggagacatcgccaaggacctggggctggagccccgggagctggcggagcgcggagtccgcatcatctccagaggtaggacgcagcttttcgccctgaaccagcgcagcggcagcttggtcactgcgggcaggatagaccgggaagagatctgcgctcagagtgcgcggtgtctggtaaactttaacatcctgatggaagataaaatgaatctttaccctatagacgtggaaataatagatattaatgacaacgttccaagattcttgacggaagaaataaatgtaaaaataatggagaatacagctcctggggttcggtttccgttaagcgaggctggggatccagatgtgggcacgaactccctccagagttaccagctcagccccaatcgccacttctccctggctgtgcaaagtggagacgatgaaactaagtacccggaactggtgctggagcgggtgctggaccgggaggaagagcgggttcaccacctggtcctcacagcctctgatggcggcgacccgccccgatccagcaccgcccacatccaggtgacagtggtggatgtgaatgaccacacgcctgtcttctctctgcctcagtaccaagtaactgtccccgagaatgtgccagtgggtacaagactgctcacggtacatgctatcgacctggacgagggagtcaatggggaagtgacatattcttttcggaaaataactcctaaacttccaaagatgtttcatctgaactcgcttacaggagaaatatcaactttagaaggattagattatgaagaaactgccttctatgaaatggaggttcaggctcaagatggtcctggtagtctgacaaaggcaaaagtactgatcacagttttagatgtaaatgataatgctccagaagtgactatgacgtctttaagtagctcaatccctgaagacacacctcttgggacagtcattgctcttttctacctacaagacagagattctggaaagaatggtgaggtgacctgcaccattccagaaaacctaccttttaaattagaaaaatcaatagataattattatagattggtcacaaccaaaaacttggaccgggaaacactctctttgtataacatcacactgaaagccacagatggtggaactcctcccttgtccagggaaactcacatattcatgcaggtggcagacaccaacgataacccacccaccttcccccactcatcctactcagtctacatcgctgagaacaaccccagaggggcctccattttcttagtgactgcacaggaccacgacagtgaggataatgcccagatcacttattccttggccgaagacaccatccagggggctccagtgtcctcctatgtctccataaactctgacactggagtcctgtacgcgctgcaatcctttgattatgagcagttgagagaactacaactaagagtgactgcacatgacagcggggacccgcctctcagcagcaacatgtcactgagcctgttcgtgctggaccagaatgacaacccgcccgagatcctgtacccggccctccccacagatggttctactggcatggagctggcaccccgctccgcagagcccggctacctggtgaccaaggtggtggcggtggacaaagattcaggccagaacgcctggctgtcatacctcctgcttaaggccagcgagccaggactctttgcggttgggctgtacacgggcgaggtgcgcacggctcgggccctgctggacagagatgccctcaagcagagcctcgtggtggccgtccaggaccacggtcagcctcctctgtcagccaccgtcacactcaccgtggctgtggctgacagcatccccgaagtcttggccgacctgggcagccttgagccctccgacggtccttacaactatgacctcacgttgtacctggtggtggcggtggccacagtctcctgcgtcttcctagccttcgtcctcgtactgctggcgctcaggctgcggcgctggcacaagtcacgcctgctgcaggcttcagaaggtggcttggcgaacgtgcccacctcgcactttgtgggcatggacggggtgcaggctttcctgcagacctattcccatgaggtctccctcaccgcggactctcggaagagtcacctgatcttcccccagcccaactatgtagacatgctcatcagccaggagagctgtgagaaaaatgattctttgctaacatccgtagattttcaggaatgtaaagaaaacctgccaagtattcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24906 - DNA, 4605 bp, Homo sapiens
atggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24907 - DNA, 4590 bp, Homo sapiens
atgcagagagccagagaagccgaaatgatgaaaagtcaggtactgtttcccttcctgctgtctttgttctgcggggccatctcccagcagatccgatacacgattccagaggagctagccaacggctcacgggtggggaaacttgccaaggatctggggctcagtgtccgggagttgccaactcgaaaactgcgggttagtgcagaggattatttcaacgttagtttggagagcggggatttgttagtgaacggtaggatagatcgagagaagatttgcggaaggaaacttgagtgtgcactagaattcgaaacggtcgctgaaaacccaatgaatgttttccacgtggttgttgtaatccaagatattaatgacaatgcaccacgtttcgttgcaaaaggcattgacttagaaatttgtgagtcagccttacccggggtaaaattctctctggattctgctcaagatgcagatgtggaaggcaattcactgaagttatacaccatcaaccccaatcaatacttctctctgtcaacgaaggaaagtcctgatggaagtaaatatccggtattactgctggaaaaacctctagacagggaacatcagagctctcatcgcttaatcctgactgccatggatggcggggacccgcctctaagcggcaccacccatatctggatccgagttacggatgccaatgataatgctcccgtgtttagccaggaggtatacagggttagcctccaagaaaacgtaccgtggggaacctccgtgctgcgggtgatggccacagaccaggatgagggcattaatgcagagatcacctatgccttcctcaattccccaataagtaccagcctcttcaatctcaatccaaatactggcgacatcacaaccaatggcacattggattttgaagagacaagtagatatgtgttgagtgtggaagctaaggatggaggagtacacacagctcactgtaatgttcaaatagaaattgttgacgagaatgacaatgccccagaggtgacattcatgtccttctctaaccagattccagaggattcagaccttggaactgtaatagccctcataaaagtgcgagacaaggattctgggcaaaatggcatggtgacatgctatactcaggaagaagttcctttcaaattagaatccacctcgaagaattattacaagctggtgattgctggagccctaaaccgggagcagacagcagactacaacgtcacaatcatagccaccgacaagggcaaaccagccctttcctccaggacaagcatcaccctgcacatctccgacatcaacgacaatgcacctgttttccatcaggcctcctatgtggtccacgtgtctgagaacaacccacctggcgcctccattgcacaagtaagcgcctccgacccggatttgggacccaacggcagagtctcctactctattctggccagtgacctggagccgcgggagctgttgtcctacgtgtccgtgagcccgcagagcggggtggtgttcgcgcagcgcgccttcgaccacgagcagctgcgcgccttcgagctcacactgcaggccagggaccagggctcccccgcgctcagcgccaacgtgagcctgcgcgtgttggtgggcgacctcaatgacaatgcgccacgggtgctgtaccccgcgctggggcctgatggctccgccctcttcgatatggtgccacgcgccgcagagcccggctacctggtgaccaaggtggtggcggtggacgcagactcaggacacaacgcttggctgtcctaccacgtgctgcaggccagcgagcccgggctcttcagcctggggttgcgcacgggtgaggtgcgcacagcgcgtgccttgggcgacagggacgcggcccgccagcgcctgctggtcgctgtgcgtgatggaggacagccgccactctccgccaccgccacgctgcacctaatcttcgcggatagcctgcaagaggtattgccagacctcagcgaccgccctgagccctctgacccccagacggaactgcagttttacctggttgtggccttggccttgatctcagtgctctttctcctcgcggtgattctagcgatcgccctgcgcctgcgacgttcctccagcctcgacactgagggctgctttcaaaccggtctctgctccaagtctgggcccggggttcctcccaaccacagcgaggggactttgccctattcctacaatctatgtattgcctctcattctgcaaagacagagtttaattctctcaacctgacaccggaaatggctccccctcaggatctgctgtgtgatgatccttctatggttgtatgtgccagtaatgaagatcacaaaatcgcttatgacccttctttgtcttcgcaccaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24908 - DNA, 4602 bp, Homo sapiens
atgaaagcgagctcagggaggtgcgggctggtgcggtggctgcaggtactgttgcccttcctgttgtctttgttccccggggctctcccagtccagatccgctattcaattccagaggagctggccaaaaactcggtcgtaggaaacctcgccaaggatctggggctcagcgtccgggacttgccagcccggaagctgcgggttagcgcggagaaggaatatttcacagtaaacccagaaagcggagacttacttgtgagtgacagaatagaccgagaacagatatgcgggaagcagcctctgtgtgttctggatttcgatactgtcgctgaaaatccactaaatattttctacatagcagtaattgtgcaggatataaatgataataccccgctattcaaacagactaagattaatttaaaaattggcgaatccactaagccaggtacaacatttccacttgacccagccctggattcagatgttggtcctaactcactacaaagataccaccttaatgacaacgagtactttgatctcgctgagaaacagactccagatggtcgtaaatatcctgagttgattctaaaacactctctggacagagaagagcacagtttacatcaattggtcctcacagctgtggatggcggagacccacctcaaagtggcacgacccaaatccgaatcaaagtcacggatgccaacgataaccctccagtgttcagccaggacgtgtacagggtcaccctgagggaggacgtgccgccgggcttctttgtgcttcaagtgacagccaccgaccgggatgaaggcataaacgcagagatcacctactcctttcataatgtggacgaacaagtgaaacactttttcaacttaaatgaaaaaacaggagaaatcacgacaaaggatgatttggattttgagattgcaagtagttacactctgagtatcgaagcaaaagatcctggagatctagcagcccactgcagtatccaagttgaaattcttgatgacaacgattgtgcacctgaagttattgtgacttcagtatctactcccctaccggaggattcgccaccaggaacagtgatcgccttgataaaaacgagagacagagactctggagaaaatggagaagtttactgccaagtgttgggaaatgccaagtttattttgaaatcttcctcaaagaactattacaaactagtgacagacggcgctctggaccgggaggagatcccagaatacaatctcaccatcacagccaccgacgggggcaagccgcccctctcctccagcataattgtcaccctgcacatctccgacgtcaacgataatgccccagttttccaacagacttcctacatggttcacgtggcagagaacaatcctcctggcgcctctatcgctcaaatcagtgcctctgaccctgacttgggccccagtggccaagtttcctactccatcgtagcgagcgacctgaagccgcgggagattttatcctacgtgtccgtgagcgcgcagagcggggtggtgttcgcgcagcgcgccttcgatcatgagcagctgcgcgccttcgagctcacactgcaggcccgcgaccagggctcgcccgcgctcagcgccaacgtgagcctgcgcgtgttagtgggcgacctcaatgacaatgcgccacgggtgctgtaccccgcgctggggcctgatggctccgccctcttcgatatggtgccacgcgccgcagagcccggctacctggtgaccaaggtggtggcggtggacgcagactcaggacacaacgcttggctgtcctaccacgtgctgcaggccagcgagcccgggctcttcagcctggggttgcgcacgggtgaggtgcgcacagcgcgtgccttgggcgacagggacgcggcccgccagcgcctgctggtcgctgtgcgtgatggaggacagccgccactctccgctacggccacgctgcacctaatcttcgcggatagcctgcaagaggtattgccagacctcagcgaccgccgggagccctctgacccccaggcaaaactgcagttttacctggttgtggccttggccttgatctcagtgctcttcttcctcgcggtgattctggcaatctccctgcgcctgcgactctcttccaggtcagatgcttgggactgttttcagcctggtctcagctccaagcctggacctggggttctccccaattacagtgagggtacattgccctattcctacaacctgtgtgttgcctcacaatcagccaagacagagttcaattttctgaacataaccccggaattggttcccgcgcaagatctcgtctgtgacaatgcctcttgggaacaaaatacaaatcatggagccgctggggtcccttttgcctcagatactattttgaagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24909 - DNA, 4578 bp, Homo sapiens
atggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24910 - DNA, 4599 bp, Homo sapiens
atgggagggagctgcgcgcagaggcgccgggccggcccgcggcaggtgctatttcctttgctgctgcctttgttctaccccaccctgagtgagccgatccgctactcgattccggaggagctggccaagggctcggtggtggggaacctcgctaaggatctagggctcagtgtcctggatgtgtcggctcgcaagctgcgagtgagcgcggagaagctgcacttcagcgtagacgcggagagcggggacttacttgtgaagaaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaatttgataaaaaggaaatacatttagaaattttcgaatctgcatccgctggtacacgactatcgcttgaccctgccacggatcctgatataaacataaactcaattaaagattataagataaactctaatccttatttttcattaatggttagagttaattccgatggtggcaaatacccagagttatctctggagaaactcctagaccgggaagaacagagatctcatagcttgatattgactgccttggacggaggggacccaccaagaagtgccaccgctcacatagaaatttctgtcaaggataccaatgataaccccccggttttcagcagagacgaatatagaattagtcttagtgaaaatctgccccctgggtcccctgtgttgcaagtgacagccactgaccaggatgagggggtcaatgctgagataaactactacttccgaagcactgcccagagcacaaaacatatgttctcattggatgagaaaacaggtatgattaagaataaccagtcatttgattttgaagatgtagaaaggtacaccatggaagtggaagcgaaggacggaggtggtctctctacccagtgtaaagtaatcatagaaatccttgatgaaaacgacaacagcccagaaataatcatcacttctctctctgatcagattttggagaattcacctccaggaatggttgttgccctcttcaaaacacgggatctggatttcggaggaaatggagaagtcaggtgtaatatagaaacagacattccattcaagatttattcttcttccaataactactacaaactggtgacagatggagccctggaccgagagcagacaccagaatacaatgtcaccatcgtagccactgacaggggcaagccgcctctttcttccagtagaagcatcaccttgtatgtcgctgacatcaacgacaacgccccagttttcgaccagacgtcctacgtggtccacgtggccgagaacaacccgccaggagcctccattgcgcaagtgagcgcctctgacccggatttggggctcaatggccacatctcctactctatagtggcgagtgacctagagcccctggcggtgtcgtcatacgtgtcagtgagcgcgcagagcggggtggtgttcgcgcagcgcgcctttgatcacgagcagctgcgcgccttcgcgctcacgctgcaggcccgcgaccacggctcgcccacgctcagcgccaacgtgagcctgcgcgtgttggtgggagaccgcaatgacaacgcaccgcgggtgctgtacccagctctgggtcctgacggctccgcgttcttcgatatggtacctcgctctgcagagcccggctacctagtgactaaggtggtagcggtggacgccgactcgggacacaacgcctggctgtcctaccacgtgctgcaggccagtgagcccggactcttcagcctggggctgcgcactggggaggtgcgcacggctcgagccttaggcgacagggacgcagcccgccagcgcctgctggtcgctgtgcgtgacggtggacagccgccactctctgccaccgccacgcttcatctggtcttcgcagacaacttgcaagagatactgccagacctcagcgaccgccctgtactctctgacccccaggctgaactgcagttttacctggtggtggccttggccttaatctcagtgctcttcctcctcgccgtgattctggccattgccttgcgcctgcgacgctctctcagccctgctacttgggactgcttccatcctggtctctgtgtcaagtctggacctgtagttccccccaactacagtgaggggactttgccttattcttataatctgtgcattgcacatacgggtacaaaagagtttaatttcctaaaatgcagtgtgcccctacattccaatgaagacatggtttgcagtgtttctcctggagccttaattccacctcatggtggggaggatttgacttcacatcctgagactctgacttcgcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24911 - DNA, 4596 bp, Homo sapiens
atgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggagaagctgcacttcagcgtagacgcgcagagcggggacttacttgtgaaggaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaattccggaaagatgaaataaacttagaaatcagtgaatccgtcagcctggggatgggaacaattcttgagtctgcagaagatcctgatattagtatgaattcgctgagcaaataccaactaagtcctaacgagtatttctcattggtggagaaagacaatcctgatggtggcaaatatccagaattagtattgcagaagactctggaccgagaaacgcagagcgctcaccacttggtactgaccgccttagatggtggggaccctccccgaagcggtactgctcagataagaatcctggtaatagatgccaatgacaaccccccagtgttcagccaggacgtgtacagggttagccttcgggaagacgtgcctccaggcacctccatcctgagagtgaaggccactgaccaggacgagggcatcaactcagagatcacttattccttctttggtgtggctgacaaagctcagcacgtgttctctctggattacactacaggaaacattctaactcagcagcctttggattttgaagaagtagaaagatatacgataaacatagaagcaaaagaccgaggatctctctcaacacggtgtaaagtaattgtagaagttgtagacgaaaacgacaacagcccagaaataatcatcacgtcactctctgatcagattatggaggattcccctccaggagtggttgttgccctcttcaaaacacgggaccaagactcaggggaaaatggggaagtcaggtgtagcttaagtagaggtgttccatttaagattcattcttcttctaataattactacaagctagtaacagatgaggccctggatcgggagcagaccccagagtacaacgtcaccatcgcagccacagacaggggcaagcctccgttatcctccagcaaaaccataaccctgcacattactgacgtcaatgacaacgcgccggttttcggacagtcagcctacctggtccacgtgccagaaaacaaccagccgggtgcctccatagcgcaagtcagtgcctctgacccagacttcgggctcaacggccgtgtctcctactctctcattgccagcgacctggagtcacgaacgctgtcgtcctacgtgtccgtgagcgcgcagagcggggtggtgttcgcgcagcgcgccttcgaccacgagcagctgcgcaccttcgagctcacgctgcaggcccgcgaccagggctcgcccgcgctcagcgccaatgtgagcctgcgcgtgttggtgggcgaccgtaacgacaacgcaccgcgggtgctgtaccctgcgctgggtcccgacggctccgcgctcttcgacacagtgccgcgggccgcgcagccaggctacctggtgaccaaggtggtggccgtggacgcggactcggggcacaatgcctggctgtcctaccacgtggtgcaggccagtgagcccgggctcttcagcctggggctgcgaacaggcgaggtgcgcatggtgcgtgctttgggtgacaaggactcggtccgccagcgcctgctagtcgctgtaagagatggaggacagccacccctttcagccactgccacgctgcacctggtgttcgcagatagcttgcaagaggtactgccggatttcagcgaccatcccacaccctctgactcccaggctgagatgcagttttacctggtggtggccttggccttgatttctgtgctctttctcctcgcggtgattctagctattgctctacgcctgcgacagtctttcagccctactgcaggagactgctttgagtcagttctctgctccaagtccggacctgtgggtccccccaactacagtgagggaacgttgccctatgcctataatttttgtgtgcctggggatcaaatgaatccagaatttaattttttcacatctgttgatcattgtccagccacacaagataacctcaacaaagatagcatgctactggctagcattttaactcccagcgttgaagcagataagaagattcttaaacagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24912 - DNA, 4711 bp, Homo sapiens
gtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaa

SEQ ID NO: 24913 - DNA, 4623 bp, Homo sapiens
atgctccgcaaggtgagaagctggacagaaatctggcggtgggctacccttttgttcctcttttaccacctgggttacgtttgtgggcagatccgctacccggtcccagaggagtcacaggaagggacttttgtagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaaccagttctccctggtgactgctggacccttggatcgagaggccaaatctagctatgacatcatggtcactgcttctgatgctgggaaccctcctctcagtacccacagaactattttcctcaatatttcagatgtgaatgataatccaccctctttctttcagaggtcacatgaggtgtttgttcctgagaacaatcgcccaggggacctgctttgctcccttgcagcctctgacccagactctggcttgaatgcgcttatctcctactcactcctggagcccaggaatcgagatgtatcagcttcctctttcatctctctgaacccccagacaggagctgttcatgctactcgatcctttgactatgagcaaacccagacactgcagtttgaggtgcaggcccgggatcggggcaacccaccccttagcagcactgtaacagttcgtctatttgtgctggacctcaatgacaatgctccagctgtgctccgtcctcgggcccggcctggttccttatgtccccaagcactgcctccatcagttggtgctggccacctaatcacaaaggtgactgctgtggacttggattcaggttacaatgcttgggtttcctatcagctcctggaggccccagatcccagcctgtttgcagtctctcgatatgctggggaggtgcggacggctgttcctatcccagctgacctcccaccacagaagctggtcattgtggtaaaggatagtggtagtccaccactctctacctctgttactctcttagtgtccttagaggaagacactcatccagttgtcccagatcttcgagaatcttcagctccaagggaaggagaatctcgtctaaccctctacttggctgtgtccctagtggcaatttgctttgtctcctttggctcattcgtggcactactctctaagtgtcttcgtggggcagcctgtggagtcacatgctttcctgctggcacctgtgcctgtctcaccagatctcgaaggagggaggggcttcccccttccaatgggatcctccgaatccagctagggtcagatgaccctatcaagtttgttgatgtgggaggccactctcatggctgtacacccttggcttctgcacccactcggagtgatagcttcatgatggtgaagtcacccagtgcacctatggcaggggagcctgttcgcccaagctgcccaccctctgatcttctctatgggctagagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24914 - DNA, 4641 bp, Homo sapiens
atggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagcgaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 24915 - DNA, 6845 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaattcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttct

SEQ ID NO: 24916 - DNA, 6957 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttcagttgctgt

SEQ ID NO: 24917 - DNA, 4230 bp, Homo sapiens
aacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctgtaagtagaaggcattgattaatattctgaactgtactgagaaaaatccttaacactcataaatgaccgaatcacaagacagcaaaagtagtctctgtaaatttcaccctatttattcatacattttatgttcttttacttatttcatccacaggtacagagcatatttcagatgactattattgaacctagacaaagaatatgctttttgtttttctagaatgcacaatgtactaattactaatttatctaacaatgataaatatatatgaattgtctccatttgtaagcttcacttaatctggatatgttttaaatttatgtattttccactgtatgcatatatgactattttgttagcaaactccaaatcaacatatcacatgaaacttatattgaatgtgtttattttggtaaattaaaaagcttaagattgcttacagaaaatagttaacattcttttatcatatagaactttacttttttgagatatcccaaattatctttcaaggcaaggttttaattaaaatattattatagtgagagtgataaaataccatgtataattaatagtatacatataaaaaagctttctataaataccttgttttataaatattaattattatcctgatgatttaaatttttctctgagtgggctcacactgtaagttggtggctgataaattttagaaaaatacaaataaaagttaaatgaactattttagaagagtaagaaaataaaatcctgaatcttataagtgatttagaagttctgttttctattgctaatataaatagtatttcttttaatgcttgtatttaattaaaagtgaatggccatcataacatttttcagcttcgatttggacaagtcttataaactctattgtgactatatggaatcaaaatgtattaatgttaatatgaaagtggtgggctttaattcagaagctccttttcttaagtgtgttaaaatgtctttgaaactgctttattgtgctttgggatatatgataggcaaaaatttcatagacttgaacccatcaataaagatagtgaatgtgaaa

SEQ ID NO: 24918 - DNA, 3471 bp, Homo sapiens
gctatcaggaggagcaaaagggaaggatctgctgctgggggctcgctgggtgaccctttgccagacgaaaagagctggtcgagagagaagcgcttggcaggagctctctgcgggacctaagctccgtggctgctcgggatccctacgtccgctgctgctgaaggagcagaggggaggacgccagcggttgcttactggagcctggaggaaaatggaaacatcattccctagaaacagttgaagttgacagacctagaggttgacaaaaggacacgacactagggaatttgcattgtcatgtttcgaaataccattccaaagacctgcaaataagatcagctttgagtgaactttgacagaagatgtttcgacagttttatctctggacatgtttagcttcagggatcatcctgggctctctctttgaaatctgcttgggccagtatgatgatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaactatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttc

SEQ ID NO: 24919 - DNA, 9258 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtgaccaattttttaaaagatattttaattaatttttacttacatttttaataaactgtgctttttattgtcactgagaaaacaatgtatggaatttatatcatgcacacaagctaaaactttgaacaatatgctttaaaattttaagagacagatttgcactcacattgttatcaattaatcgtttttcccagaaaatccttttggacatactttcactaaataacctatcgtttaaacatttagctgttttgttgggtcttgaatttttgttcattttaataaacaagaaataattactaaataatcatttatattttattgattaacatagattatgctttatttctagctccacaaaacatttttagtacatgtaattttattttccatagccaaaagggcaaaaaagaagtaagaggatatttacaggcaatgagtttatacagctgctgtctatactgccctaatttttaaaatgaaagctagaattgcaaagtaaagtaaatgagggaatcacctgtaaataattaattattttaaatcatgagcttgttttctttctttattgtcctgtataaaggttttcacattttaccataaatacatttatatcttgaccctttaggaaaccacttgaagtcgtatgtctttttatcaatattatttacaatattctcttgtcccttcatctcatatcaaatatggtagatactttagtttagtttaatcacttgaggttaaataattgtttggagcaacatggaaatctcacccttagcaaaagcttttagggaagtgagaaaggttcgagtaagcagtaatgcatctagaacgacaatttcataatggaagacatggtgaggttagggaagtctcacattaatgtcactagactttaatagtttgtaaacccagcatatcagagtaaaggaatttggcagggttgaaatgtatataatatataaagcttataaaggctatgaattcataacttcaaatgttgtgtttaacttcttccattttcaggttatttatagaatattttaatgcacatatttatgtgcctaaaatccagaaccaggaaatcattgcctgggcattttttaaaatcaaagaacatggtcttgattttttaccattgaacaaagcacagtgtttcatcataagtagaaatgaaaacagaatatcctttaaaaaacttgccttgtgtgttgcttattttccagatgatgtaaaaagaatgaaacaatatagattaagagaattcagaattctattgaatattacttagtatgatatagatgtagctcacttcaaattttgcacagtattgaccaagttcaggttttaatgaaatttcctcatgcatgcttaatatatggttgaaggactgaataatgcactattatttattcccctcttacatgtttcgcgtcttaaaaattgtttattattatgctatttcctcatttccaaagtgaatgaattgtactgacataaacttgccgacttgtaagagtagtatgtttttacttcagatttccaagaaaatatttgagatcaaatacagtaacatctcatctaccttattttattgagaattaatgcattccatacccttgccaaaaaaacaaaacaaaacaaacaaacaaaaaaaaacctagtggcattagctagattagaaacgtagaatcatgaccacacctcctggcctgccaaacaagcatccacattttcaaaagatcctaaggtggtttatatgcacattaaattttggaagcaatgaagtccggggcttattccttcaggcaccaaagcaatggtttttagtataggatactttgtataggaattagattaagcatatatttccctactaattcaatcagaggtcatcgaatataatttaatattatcttgatacccccagatcatctcagtcagcatcccttgatattctctctatatacagcttcatggctgcgtttttgtcctttgatttctggctgtgacatttaacttattctgttgttgtgcctttctcacatttttttctttcagtttatagcttctagtatcctgatgggaaagtttgtgttttttgtttgttttcttaatgttgaaaaatcatgaagcttaagatgggaattaggtacacggattcaaccaaatgttttgcgactcttagacgctttctttggttaccagtagatttggaaatatgatgttggcagaagtctagtggcctgacatatgagatgtcactgtattttaaactacattttttatgagaaaatatgcaaaattttacaagccacttagcagacacatttcagtaatttaaacttgatcatttcagtaaaaacaatcatgaggtcaatcatctgttacttaatggagatagtataaagagaagcagaatttacacagagcaaccaaaccaaatatttggtcagtatatttttgggtaacgtagagcagcaaaattattactaactaaataaatctggatcaattaaatagttactttcatagaactttcactagtctataaatccctgactcaggattaaaactgtggaacccagaggaaatacccaggtatgtttaatcttaagaatacttcatataaataacgtttcaatgtaaatatttataaagaaattggttgttatttttcctaggaaggtgtaggaaggttttcttgttgttctcaatcagcactagcttcaatcaggcagaagaaacagcaggtcttggctaatcgaggtgagaacagaatgatgtaatgactaatattgcaacccgttgattttagaaggtcttgtgggcattaagggaaagcagaggaagaatgagaaaatatggtcagagtgacataggacatttgtgacttaatgaccatcgaatcacaggtgttaatctccctctctcaatttgtctttctcattaattacagactctgagagttgtcatagaattgcaaccgtaggttggccaaaaccatctttttaaaatacagaagaaagtttgccttgaattttatatgtgatatgtcattcatgttattttaccacattgttcacagggatgttaaagactattatttacttaagtggttgttccaaaggtgattcagtagttaccattaaaatattatttaaaaacatttttatatcatagagccagaagtaattgaatattgactctcgagggaagacattttctgtcttttatttcatgagctttgatttttctctttctctgcttcaccttctgcactttataccttaagtgggatttatataccacttgaatttaattagcaaaataggcaaaaagtgctaataatctattctcagggcagatgcctattggtgcctgcaaattacacagcgataaggctgaaggataggttcaaaataatgttgaggacttacacattttatagatagtttctttctattcccaaatggtatgtgaaatttttgttctattttttttattggttttcaatagttaattttgatctttatcataagaagctttagttatagactggtatttttttcattgcaatctactttaaatttatggtcagttaagcacatgtatggaagattcgaacattgtctatagtttgaaaaatctatcaacaccttcactgctttcccaatttctttatccaaatacctgttcttccttaacaaatattatgttactgtataagaatctgaattagaagttttaagttaaaatgcattgttattcactacacaatgtttcaaaaataaattttcatttgaaaa

SEQ ID NO: 24920 - DNA, 6836 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacaacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaattcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttct

SEQ ID NO: 24921 - DNA, 6901 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccggaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacaacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaattcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttcagttgctgtcttattctctttatttctcattgtgctttcccttcccttctttataatgaaaataaatcttgagtcgttg

SEQ ID NO: 24922 - DNA, 6882 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacaacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttcagttgctgt

SEQ ID NO: 24923 - DNA, 6044 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagaattatccatggagtctggaattgatcctggccaggaatatggacaagattattacagttatgagcatgggtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattttgatatgacttatgatcagaagcatgccagaaaagtgaatatatatgttgtccaaatccatttgtatattagactgtattagagtaaaactgactaatccttcctatattagtaaatcagaacacatgcaat

SEQ ID NO: 24924 - DNA, 2664 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattt

SEQ ID NO: 24925 - DNA, 2457 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattt

SEQ ID NO: 24926 - DNA, 5862 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattt

SEQ ID NO: 24927 - DNA, 3450 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatggggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattt

SEQ ID NO: 24928 - DNA, 5058 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagaattatccatggagtctggaattgatcctggccaggaatatggacaagattattacagttatgagcatgggtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattttgatatgacttatgatcagaagcatgccagaaaagtgaatatatatgttgtccaaatccatttgtatattagactgtattagagtaaaactgactaatccttcctatattagtaaatcagaacacatgcaat

SEQ ID NO: 24929 - DNA, 2905 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattt

SEQ ID NO: 24930 - DNA, 9249 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatggctggaggtacatgtattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacaacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaattttatattacaggtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtgaccaattttttaaaagatattttaattaatttttacttacatttttaataaactgtgctttttattgtcactgagaaaacaatgtatggaatttatatcatgcacacaagctaaaactttgaacaatatgctttaaaattttaagagacagatttgcactcacattgttatcaattaatcgtttttcccagaaaatccttttggacatactttcactaaataacctatcgtttaaacatttagctgttttgttgggtcttgaatttttgttcattttaataaacaagaaataattactaaataatcatttatattttattgattaacatagattatgctttatttctagctccacaaaacatttttagtacatgtaattttattttccatagccaaaagggcaaaaaagaagtaagaggatatttacaggcaatgagtttatacagctgctgtctatactgccctaatttttaaaatgaaagctagaattgcaaagtaaagtaaatgagggaatcacctgtaaataattaattattttaaatcatgagcttgttttctttctttattgtcctgtataaaggttttcacattttaccataaatacatttatatcttgaccctttaggaaaccacttgaagtcgtatgtctttttatcaatattatttacaatattctcttgtcccttcatctcatatcaaatatggtagatactttagtttagtttaatcacttgaggttaaataattgtttggagcaacatggaaatctcacccttagcaaaagcttttagggaagtgagaaaggttcgagtaagcagtaatgcatctagaacgacaatttcataatggaagacatggtgaggttagggaagtctcacattaatgtcactagactttaatagtttgtaaacccagcatatcagagtaaaggaatttggcagggttgaaatgtatataatatataaagcttataaaggctatgaattcataacttcaaatgttgtgtttaacttcttccattttcaggttatttatagaatattttaatgcacatatttatgtgcctaaaatccagaaccaggaaatcattgcctgggcattttttaaaatcaaagaacatggtcttgattttttaccattgaacaaagcacagtgtttcatcataagtagaaatgaaaacagaatatcctttaaaaaacttgccttgtgtgttgcttattttccagatgatgtaaaaagaatgaaacaatatagattaagagaattcagaattctattgaatattacttagtatgatatagatgtagctcacttcaaattttgcacagtattgaccaagttcaggttttaatgaaatttcctcatgcatgcttaatatatggttgaaggactgaataatgcactattatttattcccctcttacatgtttcgcgtcttaaaaattgtttattattatgctatttcctcatttccaaagtgaatgaattgtactgacataaacttgccgacttgtaagagtagtatgtttttacttcagatttccaagaaaatatttgagatcaaatacagtaacatctcatctaccttattttattgagaattaatgcattccatacccttgccaaaaaaacaaaacaaaacaaacaaacaaaaaaaaacctagtggcattagctagattagaaacgtagaatcatgaccacacctcctggcctgccaaacaagcatccacattttcaaaagatcctaaggtggtttatatgcacattaaattttggaagcaatgaagtccggggcttattccttcaggcaccaaagcaatggtttttagtataggatactttgtataggaattagattaagcatatatttccctactaattcaatcagaggtcatcgaatataatttaatattatcttgatacccccagatcatctcagtcagcatcccttgatattctctctatatacagcttcatggctgcgtttttgtcctttgatttctggctgtgacatttaacttattctgttgttgtgcctttctcacatttttttctttcagtttatagcttctagtatcctgatgggaaagtttgtgttttttgtttgttttcttaatgttgaaaaatcatgaagcttaagatgggaattaggtacacggattcaaccaaatgttttgcgactcttagacgctttctttggttaccagtagatttggaaatatgatgttggcagaagtctagtggcctgacatatgagatgtcactgtattttaaactacattttttatgagaaaatatgcaaaattttacaagccacttagcagacacatttcagtaatttaaacttgatcatttcagtaaaaacaatcatgaggtcaatcatctgttacttaatggagatagtataaagagaagcagaatttacacagagcaaccaaaccaaatatttggtcagtatatttttgggtaacgtagagcagcaaaattattactaactaaataaatctggatcaattaaatagttactttcatagaactttcactagtctataaatccctgactcaggattaaaactgtggaacccagaggaaatacccaggtatgtttaatcttaagaatacttcatataaataacgtttcaatgtaaatatttataaagaaattggttgttatttttcctaggaaggtgtaggaaggttttcttgttgttctcaatcagcactagcttcaatcaggcagaagaaacagcaggtcttggctaatcgaggtgagaacagaatgatgtaatgactaatattgcaacccgttgattttagaaggtcttgtgggcattaagggaaagcagaggaagaatgagaaaatatggtcagagtgacataggacatttgtgacttaatgaccatcgaatcacaggtgttaatctccctctctcaatttgtctttctcattaattacagactctgagagttgtcatagaattgcaaccgtaggttggccaaaaccatctttttaaaatacagaagaaagtttgccttgaattttatatgtgatatgtcattcatgttattttaccacattgttcacagggatgttaaagactattatttacttaagtggttgttccaaaggtgattcagtagttaccattaaaatattatttaaaaacatttttatatcatagagccagaagtaattgaatattgactctcgagggaagacattttctgtcttttatttcatgagctttgatttttctctttctctgcttcaccttctgcactttataccttaagtgggatttatataccacttgaatttaattagcaaaataggcaaaaagtgctaataatctattctcagggcagatgcctattggtgcctgcaaattacacagcgataaggctgaaggataggttcaaaataatgttgaggacttacacattttatagatagtttctttctattcccaaatggtatgtgaaatttttgttctattttttttattggttttcaatagttaattttgatctttatcataagaagctttagttatagactggtatttttttcattgcaatctactttaaatttatggtcagttaagcacatgtatggaagattcgaacattgtctatagtttgaaaaatctatcaacaccttcactgctttcccaatttctttatccaaatacctgttcttccttaacaaatattatgttactgtataagaatctgaattagaagttttaagttaaaatgcattgttattcactacacaatgtttcaaaaataaattttcatttgaaaa

SEQ ID NO: 24931 - DNA, 6284 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgcctacagctatgaagattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacacttcaaaagacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgaaaggtcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaa

SEQ ID NO: 24932 - DNA, 6056 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaagcacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacacttcaaaagacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgaaaggtcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaa

SEQ ID NO: 24933 - DNA, 6771 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacagcacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttct

SEQ ID NO: 24934 - DNA, 9237 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacacttcaaaagacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatatacaggtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtgaccaattttttaaaagatattttaattaatttttacttacatttttaataaactgtgctttttattgtcactgagaaaacaatgtatggaatttatatcatgcacacaagctaaaactttgaacaatatgctttaaaattttaagagacagatttgcactcacattgttatcaattaatcgtttttcccagaaaatccttttggacatactttcactaaataacctatcgtttaaacatttagctgttttgttgggtcttgaatttttgttcattttaataaacaagaaataattactaaataatcatttatattttattgattaacatagattatgctttatttctagctccacaaaacatttttagtacatgtaattttattttccatagccaaaagggcaaaaaagaagtaagaggatatttacaggcaatgagtttatacagctgctgtctatactgccctaatttttaaaatgaaagctagaattgcaaagtaaagtaaatgagggaatcacctgtaaataattaattattttaaatcatgagcttgttttctttctttattgtcctgtataaaggttttcacattttaccataaatacatttatatcttgaccctttaggaaaccacttgaagtcgtatgtctttttatcaatattatttacaatattctcttgtcccttcatctcatatcaaatatggtagatactttagtttagtttaatcacttgaggttaaataattgtttggagcaacatggaaatctcacccttagcaaaagcttttagggaagtgagaaaggttcgagtaagcagtaatgcatctagaacgacaatttcataatggaagacatggtgaggttagggaagtctcacattaatgtcactagactttaatagtttgtaaacccagcatatcagagtaaaggaatttggcagggttgaaatgtatataatatataaagcttataaaggctatgaattcataacttcaaatgttgtgtttaacttcttccattttcaggttatttatagaatattttaatgcacatatttatgtgcctaaaatccagaaccaggaaatcattgcctgggcattttttaaaatcaaagaacatggtcttgattttttaccattgaacaaagcacagtgtttcatcataagtagaaatgaaaacagaatatcctttaaaaaacttgccttgtgtgttgcttattttccagatgatgtaaaaagaatgaaacaatatagattaagagaattcagaattctattgaatattacttagtatgatatagatgtagctcacttcaaattttgcacagtattgaccaagttcaggttttaatgaaatttcctcatgcatgcttaatatatggttgaaggactgaataatgcactattatttattcccctcttacatgtttcgcgtcttaaaaattgtttattattatgctatttcctcatttccaaagtgaatgaattgtactgacataaacttgccgacttgtaagagtagtatgtttttacttcagatttccaagaaaatatttgagatcaaatacagtaacatctcatctaccttattttattgagaattaatgcattccatacccttgccaaaaaaacaaaacaaaacaaacaaacaaaaaaaaacctagtggcattagctagattagaaacgtagaatcatgaccacacctcctggcctgccaaacaagcatccacattttcaaaagatcctaaggtggtttatatgcacattaaattttggaagcaatgaagtccggggcttattccttcaggcaccaaagcaatggtttttagtataggatactttgtataggaattagattaagcatatatttccctactaattcaatcagaggtcatcgaatataatttaatattatcttgatacccccagatcatctcagtcagcatcccttgatattctctctatatacagcttcatggctgcgtttttgtcctttgatttctggctgtgacatttaacttattctgttgttgtgcctttctcacatttttttctttcagtttatagcttctagtatcctgatgggaaagtttgtgttttttgtttgttttcttaatgttgaaaaatcatgaagcttaagatgggaattaggtacacggattcaaccaaatgttttgcgactcttagacgctttctttggttaccagtagatttggaaatatgatgttggcagaagtctagtggcctgacatatgagatgtcactgtattttaaactacattttttatgagaaaatatgcaaaattttacaagccacttagcagacacatttcagtaatttaaacttgatcatttcagtaaaaacaatcatgaggtcaatcatctgttacttaatggagatagtataaagagaagcagaatttacacagagcaaccaaaccaaatatttggtcagtatatttttgggtaacgtagagcagcaaaattattactaactaaataaatctggatcaattaaatagttactttcatagaactttcactagtctataaatccctgactcaggattaaaactgtggaacccagaggaaatacccaggtatgtttaatcttaagaatacttcatataaataacgtttcaatgtaaatatttataaagaaattggttgttatttttcctaggaaggtgtaggaaggttttcttgttgttctcaatcagcactagcttcaatcaggcagaagaaacagcaggtcttggctaatcgaggtgagaacagaatgatgtaatgactaatattgcaacccgttgattttagaaggtcttgtgggcattaagggaaagcagaggaagaatgagaaaatatggtcagagtgacataggacatttgtgacttaatgaccatcgaatcacaggtgttaatctccctctctcaatttgtctttctcattaattacagactctgagagttgtcatagaattgcaaccgtaggttggccaaaaccatctttttaaaatacagaagaaagtttgccttgaattttatatgtgatatgtcattcatgttattttaccacattgttcacagggatgttaaagactattatttacttaagtggttgttccaaaggtgattcagtagttaccattaaaatattatttaaaaacatttttatatcatagagccagaagtaattgaatattgactctcgagggaagacattttctgtcttttatttcatgagctttgatttttctctttctctgcttcaccttctgcactttataccttaagtgggatttatataccacttgaatttaattagcaaaataggcaaaaagtgctaataatctattctcagggcagatgcctattggtgcctgcaaattacacagcgataaggctgaaggataggttcaaaataatgttgaggacttacacattttatagatagtttctttctattcccaaatggtatgtgaaatttttgttctattttttttattggttttcaatagttaattttgatctttatcataagaagctttagttatagactggtatttttttcattgcaatctactttaaatttatggtcagttaagcacatgtatggaagattcgaacattgtctatagtttgaaaaatctatcaacaccttcactgctttcccaatttctttatccaaatacctgttcttccttaacaaatattatgttactgtataagaatctgaattagaagttttaagttaaaatgcattgttattcactacacaatgtttcaaaaataaattttcatttgaaaa

SEQ ID NO: 24935 - DNA, 448 bp, Homo sapiens
tatgcaggatttccaggaaaatggaaacatcattccctagaaacagttgaagttgacagacctagaggttgacaaaaggacacgacactagggaatttgcattgtcatgtttcgaaataccattccaaagacctgcaaataagatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaa

SEQ ID NO: 24936 - DNA, 11967 bp, Homo sapiens
gacaggggctctgggcggccggggagcatgcccgcgcggctacgctgaatggcgcctcctctgcgacccctcgcccggctgcgaccgccggggatgctgctccgcgcgctcctgctcctgctgctgctcagtcctttgccaggagtgtggtgctttagcgaactgtcttttgtaaaagaaccacaggatgtaactgtcacaagaaaggacccagtcgttttagattgccaggctcacggagaagttcctattaaggtcacatggttgaaaaatggagcaaaaatgtctgaaaataaacggatcgaggttctttctaacggctctttatacatcagtgaggtggaaggcaggcgaggagagcagtccgatgaaggattttatcagtgcttggcaatgaacaaatatggagccattcttagtcaaaaagctcatcttgccttatcaactatttctgcatttgaagtccagccaatttccactgaggtccacgaaggtggagttgctcgatttgcatgcaagatttcatcccaccctcctgcagtcataacatgggagttcaatcggacaactctacctatgactatggacaggataactgccctaccaacaggagtattgcagatctatgatgtcagccaaagggattctggaaattatcgttgtattgctgccactgtagcccaccgacgtaaaagtatggaggcctcgctaactgtgattccagctaaggagtcaaaatccttccacacaccaacaattatagcaggtccacagaacataacaacatctcttcatcagactgtagttttggaatgcatggccacaggaaatcccaaaccaatcatttcttggagccgccttgatcacaaatccattgatgtctttaatactcgggtacttggaaatggtaatctcatgatatctgatgtcaggctacaacatgctggagtatatgtttgtcgggccactacccctggcacacgcaactttacagttgctatggcaactttaactgtattagctcctccttcatttgttgaatggccagaaagtttaacaaggcctcgagctggcactgctcgatttgtgtgtcaggcagaaggaatcccctctcccaagatgtcatggttgaaaaatggaaggaagatacattcgaatggtagaattaaaatgtacaacagtaaattggtaattaaccagattattcctgaagatgatgctatttatcagtgcatggctgagaatagccaaggatctattttatctagagccagactgactgtagtgatgtcagaagacagacccagtgctccctataatgtacatgctgaaaccatgtcaagctcagccattcttttagcctgggagaggccactttataattcagacaaagtcattgcctattctgtacactacatgaaagcagaaggtttaaataatgaagagtatcaagtagtcatcggaaatgacacaactcattatattattgatgacttagagcctgccagcaattatactttctacattgtagcatatatgccaatgggagccagccagatgtctgaccatgtgacacagaatactctagaggatgttcccctgagacctcctgaaattagtttgacaagtcgaagtcccactgatattctcatctcctggctgccaatcccagccaaatatcggcggggccaagtggtgctgtatcgcttgtctttccgcctaagtactgagaattcaatccaagttctggagctcccggggaccacgcatgagtaccttttggaaggcctgaaacctgacagtgtctacctggttcggattactgctgccaccagagtggggctgggagagtcatcagtatggacttcacataggacgcccaaagctacaagcgtgaaagcccctaagtctccagagttgcatttggagcctctgaactgtaccaccatttctgtgaggtggcagcaagatgtagaggacacagctgctattcagggctacaagctgtactacaaggaagaagggcagcaggagaatgggcccattttcttggataccaaggacctactctatactctcagtggcttagaccccagaagaaaatatcatgtgagactcctggcttacaacaacatagacgatggctatcaggcagatcagactgtcagcactccaggatgcgtgtctgttcgtgatcgcatggtccctcctccaccaccaccccaccatctctatgcgaaggctaacacctcatcttccatcttcctgcactggaggaggcctgcattcaccgctgcacaaatcattaactacaccatccgctgtaatcctgttggcctgcagaatgcttctttggttctgtaccttcaaacatcagaaactcacatgttggttcaaggtctagaaccaaacaccaaatacgaatttgccgttcgattacatgtggatcagctttccagtccttggagccctgtagtctaccattctactcttccagaagcaccagcaggcccaccagttggagtaaaagtgacattaatagaggatgacactgccctggtttcttggaaaccccctgatggcccagaaacagttgtgacccgctatactatcttatatgcatctaggaaggcctggattgcaggagagtggcaggtcttacaccgtgaaggggcaataaccatggctttgctagaaaacttggtagcaggaaatgtgtacattgtcaagatatctgcatccaatgaggtgggagaaggacccttttcaaattctgtggagctggcagtacttccaaaggaaacctctgaatcaaatcagaggcccaagcgtttagattctgctgatgccaaagtttattcaggatattaccatctggaccaaaaatcaatgactggcattgctgtaggtgttggcatagccttgacctgcatcctcatctgtgttctcatcttgatataccgaagtaaagccaggaaatcatctgcttccaagacggcacagaatggaactcaacagttacctcgtaccagtgcctccttagctagtggaaatgaggtaggaaagaacctggaaggagctgtaggaaatgaagaatctttaatgccaatgatcatgccaaacagcttcattgatgcaaagggaggaactgacctgataattaatagctatggtcctataattaaaaacaactctaagaaaaagtggttttttttccaagactcaaagaagatacaagttgagcagcctcaaagaagatttactccagcggtctgcttttaccagccaggcaccactgtattaatcagtgatgaagactcccctagctccccaggtcagacaaccagcttctcaagaccctttggtgttgcagctgatacagaacattcagcaaatagtgaaggcagccatgagactggggattctgggcggttttctcatgagtccaacgatgagatacatctgtcctcagttataagtaccacaccccccaacctctgattctttcactggcagtgattcaggtggagattccgcattgaggaagtgtgaagaccctgctgtgtcatctgttagtgagcagacttcctccttagttctgcagccgccatctgccatgctatgctttgataaaaatgattttccaatctagacggccatgctcaggtattctcaccattaaatctgttcgaaggacaatgaacagggaaccaaagccttttgtgaaaatcttaatatctttatggggtattttagctttttttgaatgtgttttgttttttatttttaaacttgtgtaatttgaatgtttcattgtcagcaatgtgaaagaacggtcgagatgtttgactggattataaaatatatcactggagcaaagggaagacttttgaaagcccctttgctgactatctacctcagtttgcctcccggcaaactctgaagacaactttgttacctcatttgttgttatagtttatctcagctacataaccaatgatacttcctagtagtattgtgttttcattgctgtacgtgtaatgtgtgtgatcaaaggagtcatataggtagatgagtaagaatgtttatctgaagctctgatttttttaaaaaaagaaactatgacatctgcatggtttggataagttcatacctctggctgtgaggaccgttaaaccactgagaagaggaaaagtggggctatttcttctaacgatgaccaaaacaagaaagtatatttcttttgagaacagaactattcaataccaggtagggatcattttgcttaaaaggcctttatgttttgggcattagagtctgagtgctttatctcctatatcccaaacctcaagctgcccagaactgtgccttttctaccttcccctttgcctgacggttggccaaaggctgcactgtctagtttgcaaagcatcctcaactttgccagtattagttgcaaaaccccatgcagaatatggatttttaaagaaaatgggttaaggtggttttttttctttttttaaatcccagtttggcttaaaggagtgaagacatttcatgaactattaagaatgaaggtaaatgcaacagtagacagtaaaatgaactcgaagttattatggtaacagtgcctttcagtataatgaaattctttgccttatacctttttaatattcatgaaattgtttaggaacaggagtacaaaaagttgccttaagagtttcttggattttatcagtaactattttgatgtatagtatcttaccaaggcattttttttaagtgcaggttttgtttagggataaatattcagagttctaccaccctacttgtgttttcttgaattctttagagaatatggtatctacttaatcttccttcagtgtcagtgctgtgaatgaggaatgctaactccaggagtgagttaatcctcttgcaggtttgaaatcagcaaattgtttactcagctacataacataggccttttctccgtcatgagacagttacctaggtgccgagcagtgggagaggataaagaactaaacgcgtgtagagaaggggtcccatatccttttaaaagtattttttcaaattttctggaagtgacttttgattctcattttaaaaggaatcataatgggtttacacttgaaatgctttgttcctagaggaggcagggtcatgttcactgatgttctaaaatcaaaggaatattagcagataatagtcccagcatcatctgctagtctaatgactgtagatataacatttttaatttttttaaatctgtaattttgtgccaaactggatgtgattaagactaaagttcaatgccagcaaccacttctgaactaaactcagagtcccccagttagttatctaagtacggaattcatcgcaaaacaaacaaaaaagcagagctttaggtgaacagtctgcagcaaggaaaaatgctgctcctgcctttatagctcctgttttatactacctccttttaaagttattctagtgttattttttttcctgtactcagggaacgttttgttacttttgagctgcctcatggaagcataggcagattgacagggtatagcgctttgtggttggtaagtagaagtatatagggccaacttttatcagtatctaaaattaagtacagtgagatcattttatttttaagctttcattaaaaggcaaacaaaatctaaagctgaaacatcatccatcatggttatggaagatgtgtctaggactacatgaattcgagtggttttaaatggctaaaaagacgagctaaagtccttgaggaaagtattttgtttgtttggtttttgatgaataggcttatagttacaatagaactttaggctataactatttgataattatttaacagtacattttttaccttttcattttgttcttatacggactttttcataataattctgttaccaaagaattttcagtagaaaataaaattttgattataattccccccaaattgaattaactagaagcatttatagatatgaaacttacacaagtagttactaacccaaaacaatagggtttatattgattgttgtagttaaatagattagtaatgttaactaccttattgttaccagagcatttaaaataagttgtaatactttctttaccagcagatcgttccaaagaatttcaggtatagttttttcttcagcaagtaaatcttcaactatacagtattaaagtatttttatattgttgaaactacttgttggagagaaaattttttttttttaccaaaaataaatactttggtctcattgaataagatatttagtaatacagcaaagacttctttttacttgaccaaatcaagcttctttgaagtcttaagtatgaaattgtaattaaaatgtgaagattttcactcatttttcatagtggtattacttcatggtattgtacttcaaaggggctaatatgcaaatggtaactattttcttttccaaagatgtatttgctgtaagtactgatacctgcatgtcatttttatgccaaatattacaagatactgctcatcagtattttcataccaaagaccattaagatgtataggttagcctgtaagtaagtaaagatgagcagatttgaaataaatttatttagaggccgatagagaatctagctttagtagcaaaaaatatcaaagggctaagtttacataattaaaagcaatacaattatattggtatttatcagtgtttttattcaagtactttttatcagcaaattaaaaagaaaaaaaccaaagatatttaaggttacctccgcatataggcaaatatagttgtacattaaactgttgtttcttgtttttatgttaaaccaaacatgtctcttcggaacacagtctgtatacaaataacatgcatgaggactttccatttaatctgtgattcagccacatgatgtttttgccaaatgatgtgatactttccaaagcaccttgagtgtgaaatgtcaacagaaatatcagcaagcttttatgttgcagagtattatggtacctctgaattagcctgtatagttctcttcctgctttaagcattacctggttagctcagacggcttgaggcagtcccttaataatagggatgcttttcatctctaaggatgtaagaggcaaacaaatcatgtcattctttaagtgggctatgctttgatagatgtgctctttaaaggtgtgagattggaatttagagttgttaaattgaaatgtttgcattgcaccaaaggagctcagttttcaaactttaatggaaccttgggtaaagggaaaaaatttttaatgaaatctggggttttatattttgattagcctaaaagtaaaaatacagctttatccattaagtgacttttaaaaatcagttttgccataccaaagaaattagattcttagtgtcacatgctatacttttgtctgtgcttgaaacgagcaatgccaacattgggaacaatgacagaggtttgcatcagtttgtcttggctttgttaaggacttctgccagaaatgtgctcgtggttgacaacccaggatcattgttcaagttcttatgcagacacctttgaaaacaattcagatcgtgtcacaagaatttggaattgaaaatatcatttattttttaatgcaagaatacccagatgtggtttcacttcagcagtagctatagtggttcacttatatacatttctgtttcactgaatgtaaattttgaatactgaatgtaaaaaaaaaactccagttatattgaaacagtcactaagactgcacatgtgttttgcagactttcttcctgaccatttgccacatgggtctctgataagattctgttggtttaatagtcaaaataatctttgcagtttgtgagcactgagtagcaggttctggagactaccatatacaaccagttgtctaattgtgatttttttattgatgtttagaagaatgtaaccgtagagttctgtgttaagttgatttatgctcaggacataagatcacaggctaatgcaatgtgtatgtttcaggctttaatcttctcaatttccctttttaagccgttgatggtgtttaagattaacatgacagtcttgtatttttaccagatactgtattatttttcctattgctgctgtaacacattaccatgaaggtggtggcttaaaataacacaaatttttcttaagttctgcagatcagaagtctaacacaggtctccctgggacaaaatcaaggcgcttgcagggctgtttctttttgaggctttagggaaaaatctatttccttttctagttttttaaggctgggaacccctccttccatcttcaaagccagccatgtagcatctctctgaagctccttccgttatcatttctctttgtccaaccccagctgatacaggttatctaggtttaaggattccagtgatcacattgagcccacctaaataatccaggataatctccccaactgaagttcctcaacttaatcacatctacagagttccttttgctatgtttggtaacatattcactggttccagggatttgggcatggacttctgtaggtggccagtattttgcccacaacaggtacattctttctgtggaattctgatccctgtaaaatgtctgtagcattaaagagattggaaatctgaggtcatgtgccccttggggatctttaaagattaaaagcatgaaaactttgacttgtagcctaccaaaattatacactaaactttctctccaaaatacttgtgaaacaatttatctttaaagtttctgaatatgtgcttcataaaataacatctcatgtttatcagcaagtgtcctaaatatttgcgtctaactttatggaatttattcagaaaaagaattgaaaactcttcttatagttaccctttctccttttctcttcagtggttatgttgctggggaagagttgggggaagacctcaaaacacaggaactcagagtgatgaacaggaccatgctcaagtttattctttgttttcttttaatgacatattcacaacattcacaactttctgcctttaaatctggttcctctcttcagcttcaccaagccactgaatgcttttcagttttattaaccctcacattccccatccttctcagcaagagcctctccttatgccatcagcatgtatatacatttcctaggaaatttgatctttcttgtcattcttttttggttccaatcggccttttcctggttctcaaagctctagtttcttctaatttctggatcatcgcaagtctggccctctttgaactttaaaacataatgtctaattccaccccaattttcagcatttcttcaactaaatcgataaagctgtctccattatgagaaaggccagaataatactccgagtaagcataagaaagctggtcattttacaacttctcccgactctaggaagtaatatgatgccatttgttgagcatctacagtgtgccaagcacatggttcatctctgcaaactgctgctacattctgtaaagcaagtattatccgcattttagggattaggaacagcttcctgatctcttgccaaaagtcacagctagtgagtggtttaggcaagatacaaaccctagttagttaatccttactcagaagtgtataggactatgatacattgtctcagcttaaaaaaaaaaaaaaaaaaaaaaggtatttaatcacccagggtcatagtgccttccatagtgtgaccagatacaactgttttttccttgtatccacaaaagccaggttgtgtcagaacaacctttctacagagtaataaccaatcgaaaaagagaagactaccttatttaaatccacttattcacaggagggattaaggcggctgtaactcatcccttatcatctcctaatttctctcctccaaaaccttccatttatctcagctaaaattgtgtctgaaggctgtttgtacttagagttacattacaaataaggtaggcatggtttctagagtccttttctagtcaagcatttccttattcgacaatgtcttcagaattgcattttatcttttgtaattttctgtagctcccatattccaaacaggaattcattgacttgaaaaagtcaggtgtgtaaacagtaatcctttcttgttaggtctgaagagttcatgattttttatgaatataaactaatttattatttgcattaatgtaggagacagcaaagttaacggagagtcataaaacagaacaagtataagttaggctttggagcacctaagttctaatcttgacaattttgagaatcgtttggtacaaaaattcttaaactgtttctgtgccttctccatccatgaaatgaggataatttttttgtgcaaaatgaaacaatagtactttgaaaacttaagagaaaattcaagtgtaaataatcataatctgaaactcatttgtatgaggctgtgaaagattttacagactctttcttttcaagtcagcctttgcaattatattttgcctttgttgaaatgaaaaatgtttgcatctcccgtacgcatacacaaaaccaatagaagaaagtggttggtaaaagatatagctgaaatggaaacactcatatgttaggtggataaaatcataagagaaaatgggaattgactgtactttcaaagtactaaatttgaagtcatcttactccaatttaagtcatatatatatatatatatatatatatatatatatatatatatatatatatattggcttttaaagagttaaagagagaatcagatctgtccagcaggatagatgggtgaggagaaaagtacatatttaggatttttctctaaaagatctttttcaagattatggagtattttaatatttctgcaaactattccaaatgaatgcattttatatagggcaacacatactggcacctgattctggtttattcgagttcatatgtagggtttgttgggaagaattatatgattggcttctttttttagaggaaatattttcccttttttcttatccatatactattctgaacagctttgcagatttccttaagttcatagcttgtaagtagttcatggtatatagacatagtcttgacttacaactgaaaaaaaatttatgttacagaagtttattttttctatggaactgtctttaaaaacaaaaatattacaaatcttgaccttgaaatattctgtttcctgttatcacattctggatatctattttgtttgcaaatgaaaattattactgatgattagcaacttgagcctgttaataggaaattgcaaagcctgaatacacacacattgccttagcctatcagtagagtagaggacatatgttaagaaaatgtgtctgcttgttgctgttgttggacaaaattttatgtctgtgtgtatgatttttttttttctattttcttcaaagatgtgaattaaatgaaagtgtgggagccagttaaattattttgtattatgggtgttctggatcctttcactccgtataccattttcttgtaagggcagcatttgtagacttgctaatggactgtagagctgagctatattaattttatacttgactcaggggatcagttctgtgaatgccattgcacgaagaaagcaaatgtttgccttgattttgaatgtatctttttaatgtcttcttaaaacatatttgtttaataatgtagatttgtttttttttttctagtatcatagtaaatattgcttagtacttgcccccaccccactgggtagtttatatactaccctataggtcatgccaaaaatgaataaaagtttaaatgccaaaatgtttatgaaactgctgtctaaatactgattgattgcacaatttaaataaaagctttccttagttaaaaaa

SEQ ID NO: 24937 - DNA, 1686 bp, Homo sapiens
gccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtatctctaagggacagcagtctggaggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttg

SEQ ID NO: 24938 - DNA, 1740 bp, Homo sapiens
gagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtatctctaagggacagcagtctggaggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagct

SEQ ID NO: 24939 - DNA, 922 bp, Homo sapiens
agagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctgggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaccaagaaccagttgaagtggcgacagagtcatgacaggaccgtggagtggcctaaggagtacccagggcgaagtaggaaacaggctccttctattcttcatgtgcctgggtgccaactcctcaggtgcagggaccgtgaccacctgggggctgtaagcgaacagccccggagctcggcggagagtagggtgggggtggcgtcctctaccttttctacctttcccctcttctagcgggggtggggaggagggttactgctgaagagaaa

SEQ ID NO: 24940 - DNA, 1576 bp, Homo sapiens
acttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggcatgtggagagcaggtttctgagcttggcttggattcagaagtgctgcctgtccggggagaccacccagctgcccagaacaggttcctctacgtgggcggtgccctgcatgccctacccactggcctcagtcctagtctcacccttaaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtatctctaagggacagcagtctggaggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttg

SEQ ID NO: 24941 - DNA, 483 bp, Homo sapiens
atggacattctgaaatcagagatccttcggaagcggcagctggtggaggacaggaacctgctgagtgagagtatgtgtgcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttc

SEQ ID NO: 24942 - DNA, 788 bp, Homo sapiens
tgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtgaggaactcgattgaggaccagaggtccagtcacaagtaacaagccactagccaggtgcttcaggaagaccgccctcttgcctctgtggaatccagtgaggatgatcagaacgttccccggggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataa

SEQ ID NO: 24943 - DNA, 747 bp, Homo sapiens
atgatcagaacgttccccggggaaaataaaaaatatttcaagcgtagtgagctcgccaaaaaagaagaggaagcatattttgaaagatgtggctacaagcctataaatgagaagccatctggagagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaagacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaa

SEQ ID NO: 24944 - DNA, 1717 bp, Homo sapiens
ctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaagacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaattcatgttgcagagagaatacgtgaaggcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttcttgctttcattttaattagtccaaaattaagttttaaagatttttcctcacaatttaaatccatagacaacagaagggggtttaaaatgacctttttttcagttgacccgaaagttgtggttagatgattaaaaagaaacatttgaggatggacttaattatttcagtaaaatattataatttgcctattgtcttttatgtaatatttatataaaatatttttatatatttcaaaaacatgggaccattgaatgaaactttatagtccttaaatgttgctgaacttttgctgtcttgcaatagaatttgaatgtaaatattattactggta

SEQ ID NO: 24945 - DNA, 1062 bp, Homo sapiens
agcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtgaggaactcgattgaggaccagaggtccagtcacaagtaacaagccactagccaggtgcttcaggaagaccgccctcttgcctctgtggaatccagtgaggatgatcagaacgttccccggggaaaataaaaaatatttcaagcgtagtgagctcgccaaaaaagaagaggaagcatattttgaaagatgtggctacaagcctataaatgagaagccatctggagagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaagacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaat

SEQ ID NO: 24946 - DNA, 2157 bp, Homo sapiens
ggcaatttccgttaggtgctgaaggctgtggcgcgcggctgtccccattcccacgtgaagcgctacgctagcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccatctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaagctctggctaccctgaaaccacaggctggcctcattgtgccccaggctgtgccaagttcccaaccaagtgttgtgggtgcgggtgagccaatggatttgggtgagctggtgggaatgaccccagagattattcagaagcttcaagacaaagccactgtgctaaccacggagcgcaagaagagagggaagactgtgcctgaggagctggtgaagccagaagagctcagcaaataccggcaggtggcatcccacgtggggttgcacagtgccagcattcctgggatcctggccctggacctctgcccgtccgacaccaacaagatcctcactggtggggcggataaaaatgtcgttgtgtttgacaaaagttctgaacaaatcctggctaccctcaaaggccataccaagaaggtcaccagcgtggtgtttcacccttcccaggacctggtgttttctgcttcccccgatgccactatcaggatttggtcggtccccaatgcctcttgtgtacaggtggttcgggcccatgagagtgctgtgacaggcctcagccttcatgccactggcgactatctcctgagctcctccgatgatcagtactgggctttctctgacatccagacagggcgtgtgctcaccaaggtgacagatgagacctccggctgctctctcacctgtgcacagttccaccctgacggactcatctttggaacaggaaccatggactctcagatcaagatctgggacttgaaggaacgtactaatgtggccaacttccctggccactcgggccccatcactagcatcgccttctctgagaatggttactacctggctacagcggctgatgactcctctgtcaagctctgggatctgcgcaagcttaagaactttaagactttgcagctggataacaactttgaggtaaagtcactgatctttgaccagagtggtacctacctggctcttgggggcacggatgtccagatctacatctgcaaacaatggacggagattcttcactttacagagcatagcggcctgaccacaggggtggccttcgggcatcacgccaagttcatcgcttcaacaggcatggacagaagcctcaagttctacagcctgtaggccctggcccttctgatggaagctgggcctcatctcagtagaggggtagaattagggtttgggggggggggtggggggaatctatggggggagggggctctgtggggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataa

SEQ ID NO: 24947 - DNA, 1130 bp, Homo sapiens
agaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcagagaagaaggtggctgaggccaaccagaagtatttctccagcatggctgagttcctcaaggtcaagggcgagaagagtggccttatgtccacctgaatga

SEQ ID NO: 24948 - DNA, 2126 bp, Homo sapiens
cgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccctttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtc

SEQ ID NO: 24949 - DNA, 1744 bp, Homo sapiens
agaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctggacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtc

SEQ ID NO: 24950 - DNA, 886 bp, Homo sapiens
tggtgcgcggagaggagagtttttagggaacgctgctgtccctccccaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccaca

SEQ ID NO: 24951 - DNA, 928 bp, Homo sapiens
ggtgagcgactaacgctagaaacagtggtgcgcggagaggagagggaacgctgctgtccctccccaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccac

SEQ ID NO: 24952 - DNA, 854 bp, Homo sapiens
ggagaccacggggagcgggaggctgggctcctgggtctgggagaagaagtgtgtgaggaaaaaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcggg

SEQ ID NO: 24953 - DNA, 3496 bp, Homo sapiens
cagagttcagccccgagccgcgcgagtcgactcacctacctcttttcaagccggcctagccccttcccggaacctcggctcccccccaacgaaactactgctaagccaactggactacacttcccagactgcttggagcctctctctccgcagaacctcgtcttccgcgagcttttcctggaggttctaggagggatgcccctcaatgccacgacgccatttcctactacgacttccatcatgctccgcgccgctccgggggcggtgacccctcttggcccacgtcttgtcagtgacgcacttcctgtcagtgacgcacttcccctctgctgggcgcgcggtggacggtctgaaagggagtgttcgggtttcgctggggcctcgcggctccagagcccagcatggcttcctcgcgagcctcttccacgcaggcaaccaaaactaaagcacccgacgacttagttgctccggtcgtgaagaaaccacacatctattatggaagtttggaagagaaggagagggagcgtctggccaaaggagagtctgggattttggggaaagacggacttaaagcagggatcgaagctggaaatattaatataacctctggagaagtgtttgaaattgaagagcatatcagcgagcgacaggcagaagtattggctgagtttgagagaaggaagcgagcccggcagatcaatgtttccacagatgactcagaggtcaaagcttgccttagagccttgggggaacccatcacactttttggagagggtcctgctgaaagaagagaaaggttaagaaatatcctctcagttgtcggtactgatgccttgaaaaagaccaaaaaggatgatgagaagtctaaaaagtccaaagaagagtatcagcaaacctggtatcatgaaggaccaaatagcttgaaggtggcaagactatggattgctaattattcgttgcccagggcaatgaaacgcttggaagaggcccgactccataaggagattcctgagacaacaaggacctcccagatgcaagagctgcacaagtctctccggtctttgaataatttttgcagtcagattggggatgatcggcctatctcctactgtcactttagtcccaattccaagatgctggccacagcttgttggagtgggctttgcaagctctggtctgttcctgattgcaacctccttcacactcttcgagggcataacacaaatgtaggagcaattgtattccatcccaaatccactgtctccttggacccaaaagatgtcaacctggcctcttgtgcggctgatggctctgtgaagctttggagtctcgacagtgatgaaccagtggcagatattgaaggccatacagtgcgtgtggcgcgggtaatgtggcatccttcaggacgtttcctgggcaccacctgctatgaccgttcatggcgcttatgggatttggaggctcaagaggagatcctgcatcaggaaggccatagcatgggtgtgtatgacattgccttccatcaagatggctctttggctggcactgggggactggatgcatttggtcgagtttgggacctacgcacaggacgttgtatcatgttcttagaaggccacctgaaagaaatctatggaataaatttctcccccaatggctatcacattgcaaccggcagtggtgacaacacctgcaaagtgtgggacctccgacagcggcgttgcgtctacaccatccctgctcatcagaacttagtgactggtgtcaagtttgagcctatccatgggaacttcttgcttactggtgcctatgataacacagccaagatctggacgcacccaggctggtccccgctgaagactctggctggccacgaaggcaaagtgatgggcctagatatttcttccgatgggcagctcatagccacttgctcatatgacaggaccttcaagctgtggatggctgaatagatgacaatgggaaaaggacttgaacctcaagctctctctaaggagctgttttcctcaaacgagaagaattgaagtgtttagttctatcatgttttctgccaattaccatgcatagaccctcagtagaattggatttccatgtcagcccccactccaggaaggcagcccaatccctaggtgatggggaacccctctcacggttgaaaatttattacctttttacgccctgccacgaactgtgtagacattgtttttattaatcttttgtttggccgggcgtggtggctcacgcctgtaatcctagcactttgggaggccgaggtgggtagatcgcttgagctcaggagttcaagacgagcctgggcaacatggcaaatgccgtctctgcaaaaaaatactaaaattagctggtcgcggtggcttctgcctgtgattccggctacttgggaggctgaggtgggagggattgcttaagcctgggaggcagaggttgcagtgagccgagattgcgccattgcactctagcctgtgtgacagagcaagaccctgtctcaaaaaaaaaaaaaatttgttcgaatgccttatagccttcctcacagcacccaggattgtgactgactctgcatttttaattcttgaaacttggctttccataacatggtacatgcttcaggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaacgaaaaaaccctaatgggtgttcctaaacctaaaccttttctttattccacatttgctacggtaaaatcctgttacaaaactaccctataaagaattattttctatagttaagcattttctgaatcctagccattggtccatagaggtctcttttttttggtttgggatataatggatgatctcaaatatggattactctgatttatgtctccttagcaccttgttaacaattttttttaaaatagaaggctgtttgcattttgggccagactgccagtaagccaggcctggactcaattacaattcttaacttgtctgtcatgcacctcttttcacctcaactatacagcctctgaactctcaaattacacagtaaattcaaaaaaatatataggaatttggaagaaga

SEQ ID NO: 24954 - DNA, 3493 bp, Homo sapiens
cagagttcagccccgagccgcgcgagtcgactcacctacctcttttcaagccggcctagccccttcccggaacctcggctcccccccaacgaaactactgctaagccaactggactacacttcccagactgcttggagcctctctctccgcagaacctcgtcttccgcgagcttttcctggaggttctaggagggatgcccctcaatgccacgacgccatttcctactacgacttccatcatgctccgcgccgctccgggggcggtgacccctcttggcccacgtcttgtcagtgacgcacttcctgtcagtgacgcacttcccctctgctgggcgcgcggtggacggtctgaaagggagtgttcgggtttcgctggggcctcgcggctccagagcccagcatggcttcctcgcgagcctcttccacggcaaccaaaactaaagcacccgacgacttagttgctccggtcgtgaagaaaccacacatctattatggaagtttggaagagaaggagagggagcgtctggccaaaggagagtctgggattttggggaaagacggacttaaagcagggatcgaagctggaaatattaatataacctctggagaagtgtttgaaattgaagagcatatcagcgagcgacaggcagaagtattggctgagtttgagagaaggaagcgagcccggcagatcaatgtttccacagatgactcagaggtcaaagcttgccttagagccttgggggaacccatcacactttttggagagggtcctgctgaaagaagagaaaggttaagaaatatcctctcagttgtcggtactgatgccttgaaaaagaccaaaaaggatgatgagaagtctaaaaagtccaaagaagagtatcagcaaacctggtatcatgaaggaccaaatagcttgaaggtggcaagactatggattgctaattattcgttgcccagggcaatgaaacgcttggaagaggcccgactccataaggagattcctgagacaacaaggacctcccagatgcaagagctgcacaagtctctccggtctttgaataatttttgcagtcagattggggatgatcggcctatctcctactgtcactttagtcccaattccaagatgctggccacagcttgttggagtgggctttgcaagctctggtctgttcctgattgcaacctccttcacactcttcgagggcataacacaaatgtaggagcaattgtattccatcccaaatccactgtctccttggacccaaaagatgtcaacctggcctcttgtgcggctgatggctctgtgaagctttggagtctcgacagtgatgaaccagtggcagatattgaaggccatacagtgcgtgtggcgcgggtaatgtggcatccttcaggacgtttcctgggcaccacctgctatgaccgttcatggcgcttatgggatttggaggctcaagaggagatcctgcatcaggaaggccatagcatgggtgtgtatgacattgccttccatcaagatggctctttggctggcactgggggactggatgcatttggtcgagtttgggacctacgcacaggacgttgtatcatgttcttagaaggccacctgaaagaaatctatggaataaatttctcccccaatggctatcacattgcaaccggcagtggtgacaacacctgcaaagtgtgggacctccgacagcggcgttgcgtctacaccatccctgctcatcagaacttagtgactggtgtcaagtttgagcctatccatgggaacttcttgcttactggtgcctatgataacacagccaagatctggacgcacccaggctggtccccgctgaagactctggctggccacgaaggcaaagtgatgggcctagatatttcttccgatgggcagctcatagccacttgctcatatgacaggaccttcaagctgtggatggctgaatagatgacaatgggaaaaggacttgaacctcaagctctctctaaggagctgttttcctcaaacgagaagaattgaagtgtttagttctatcatgttttctgccaattaccatgcatagaccctcagtagaattggatttccatgtcagcccccactccaggaaggcagcccaatccctaggtgatggggaacccctctcacggttgaaaatttattacctttttacgccctgccacgaactgtgtagacattgtttttattaatcttttgtttggccgggcgtggtggctcacgcctgtaatcctagcactttgggaggccgaggtgggtagatcgcttgagctcaggagttcaagacgagcctgggcaacatggcaaatgccgtctctgcaaaaaaatactaaaattagctggtcgcggtggcttctgcctgtgattccggctacttgggaggctgaggtgggagggattgcttaagcctgggaggcagaggttgcagtgagccgagattgcgccattgcactctagcctgtgtgacagagcaagaccctgtctcaaaaaaaaaaaaaatttgttcgaatgccttatagccttcctcacagcacccaggattgtgactgactctgcatttttaattcttgaaacttggctttccataacatggtacatgcttcaggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaacgaaaaaaccctaatgggtgttcctaaacctaaaccttttctttattccacatttgctacggtaaaatcctgttacaaaactaccctataaagaattattttctatagttaagcattttctgaatcctagccattggtccatagaggtctcttttttttggtttgggatataatggatgatctcaaatatggattactctgatttatgtctccttagcaccttgttaacaattttttttaaaatagaaggctgtttgcattttgggccagactgccagtaagccaggcctggactcaattacaattcttaacttgtctgtcatgcacctcttttcacctcaactatacagcctctgaactctcaaattacacagtaaattcaaaaaaatatataggaatttggaagaaga

SEQ ID NO: 24955 - DNA, 4415 bp, Homo sapiens
ggcacatgcgcggcagctcttttccttcttcctccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagagattattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggca

SEQ ID NO: 24956 - DNA, 6775 bp, Homo sapiens
ggggttttatatccggattcttagcgcggactcagaacccagctcttccctacacggtcggcacatgcgcggcagctcttttccttcttcctccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagagattattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctgaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatc

SEQ ID NO: 24957 - DNA, 3216 bp, Homo sapiens
gttgccccgggaggcgtaggcgcgagcggcctctacaggtccggtgcgcgtggcggctgccgcggcagtgaggtcgcgctttcctatgcctcttttggggacccatctgagctccctggccgcagctcttagcggcatctgtgttggggacacgagggatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagagattattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatat

SEQ ID NO: 24958 - DNA, 3096 bp, Homo sapiens
atgaggccggggacgggagctgagcgtggaggcctcatggtgagtgaaatggagagccatcctccctcgcagggtcctggggacggggagcggagattgtccggctcaagcctctgctccggctcttgggtctctgctgacggcttcctgaggagacggccctcgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacgtatactctgtataaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggtaaaatggggaaaattaagtatagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacagaaaaagaagaaaaagaagaagcaagatcaaagtacaaagaggctaaggaatcctttcagcgttttcttgaaaatcatgagaaaatgacttctacaaccagatacaaaaaagcagagcaaatgtttggagagatggaagtttggaatgcaatatcagaacgtgatcgtcttgaaatctatgaagatgttttgttctttctttcaaaaaaagaaaaggaacaagcaaagcagttgcgaaagagaaattgggaagccttaaaaaacatacttgacaacatggctaatgtaacatactctaccacttggtctgaagcccagcagtatctgatggataatccaacttttgcagaagatgaggagttacaaaatatggacaaagaagatgcattaatttgctttgaagaacacattcgggctttagaaaaggaggaagaagaagaaaaacagaagagtttgctgagagaaaggagacgacagcgaaaaaatagggaatctttccagatatttttagatgaattacatgaacatggacaactgcattctatgtcatcttggatggaattgtatccaactattagttctgatattagattcactaatatgcttggtcagcctggatcaactgcacttgatcttttcaagttttatgttgaggatcttaaagcacgttatcatgacgagaagaagataataaaagacattctaaaggataaaggatttgtagttgaagtaaacactacttttgaagattttgtggcgataatcagttcaactaaaagatcaactacattagatgctggaaatatcaaattggctttcaatagtttactagaaaaggcagaagcccgtgaacgtgaaagagaaaaagaagaggctcggaagatgaaacgaaaagaatctgcatttaagagtatgttaaaacaagctgctcctccgatagaattggatgctgtctgggaagatatccgtgagagatttgtaaaagagccagcatttgaggacataactctagaatctgaaagaaaacgaatatttaaagattttatgcatgtgcttgagcatgaatgtcagcatcatcattcaaagaacaagaaacattctaagaaatctaaaaaacatcataggaaacgttcccgctctcgatcggggtcagattcagatgatgatgatagccattcaaagaaaaaaagacagcgatcagagtctcgttctgcttcagaacattcttctagtgcagagtctgagagaagttataaaaagtcaaaaaagcataagaagaaaagtaagaagaggagacataaatctgactctccagaatccgatgctgagcgagagaaggataaaaaagaaaaagatcgggaaagtgaaaaagacagaactagacaaagatcagaatcaaaacacaaatcgcctaagaaaaagactggaaaggattctggtaattgggatacttctggcagcgaactgagtgaaggggaattggaaaagcgcagaagaacccttttggagcaactggatgatgatcaataaattataccaaatatatgtttacagtatgatttaaagtctgattcagaccagggactctattttaagttcaactgaaataacactgggttttaattatatcacaggaaaaaaaaagtgcatttaagtattgttatcgtggactttataaaagcaaaggaaattgaaagtaacttttgattctgtatcaagaatcatattttcatacagtcataactgtctttctgtgaccctttcacagggcactgtaggatggattaaaggtggcaatttactgat

SEQ ID NO: 24959 - DNA, 2470 bp, Homo sapiens
actcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatggaatgttaacggaattaaagtatagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacagaaaaagaagaaaaagaagaagcaagatcaaagtacaaagaggctaaggaatcctttcagcgttttcttgaaaatcatgagaaaatgacttctacaaccagatacaaaaaagcagagcaaatgtttggagagatggaagtttggaatgcaatatcagaacgtgatcgtcttgaaatctatgaagatgttttgttctttctttcaaaaaaagaaaaggaacaagcaaagcagttgcgaaagagaaattgggaagccttaaaaaacatacttgacaacatggctaatgtaacatactctaccacttggtctgaagcccagcagtatctgatggataatccaacttttgcagaagatgaggagttacaaaatatggacaaagaagatgcattaatttgctttgaagaacacattcgggctttagaaaaggaggaagaagaagaaaaacagaagagtttgctgagagaaaggagacgacagcgaaaaaatagggaatctttccagatatttttagatgaattacatgaacatggacaactgcattctatgtcatcttggatggaattgtatccaactattagttctgatattagattcactaatatgcttggtcagcctgttttttcattaggatcaactgcacttgatcttttcaagttttatgttgaggatcttaaagcacgttatcatgacgagaagaagataataaaagacattctaaaggataaaggatttgtagttgaagtaaacactacttttgaagattttgtggcgataatcagttcaactaaaagatcaactacattagatgctggaaatatcaaattggctttcaatagtttactagaaaaggcagaagcccgtgaacgtgaaagagaaaaagaagaggctcggaagatgaaacgaaaagaatctgcatttaagagtatgttaaaacaagctgctcctccgatagaattggatgctgtctgggaagatatccgtgagagatttgtaaaagagccagcatttgaggacataactctagaatctgaaagaaaacgaatatttaaagattttatgcatgtgcttgagcatgaatgtcagcatcatcattcaaagaacaagaaacattctaagaaatctaaaaaacatcataggaaacgttcccgctctcgatcggggtcagattcagatgatgatgatagccattcaaagaaaaaaagacagcgatcagagtctcgttctgcttcagaacattcttctagtgcagagtctgagagaagttataaaaagtcaaaaaagcataagaagaaaagtaagaagaggagacataaatctgactctccagaatccgatgctgagcga

SEQ ID NO: 24960 - DNA, 8048 bp, Homo sapiens
gatcgaaccctctcctccgaacccctcctttcgccttccccgcctcctcccctccgcctcgagcaccgcgcgcgcgcattcggtcccagccaccgctaacactacaggctgcttacccccgccccctccaccctacccctggcggcctcaggtttgtggggcgtacgtaactcgggcggggagggtgaaggtggcagacccccactgccccaccccctacggggtgaggcggtctaagctcgggaagctgggacactgttgtcttcccttcccctggggaagttggtagagttttcccgacggaggactcggcgcagaaacttcctccgtcctcctcctcccccccccccatgcaggcgacgccgagtgaggctgaggctgggggcgaatcgccgcagagctgcgtgtcggcggcgcattctgattggacagcggggaagcccgtcagcctgttggccccgctgatcccgccccgtagcgcagggcagcctttaacctttagccccagtgggcgccagccactcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatgcaatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacagaaaaagaagaaaaagaagaagcaagatcaaagtacaaagaggctaaggaatcctttcagcgttttcttgaaaatcatgagaaaatgacttctacaaccagatacaaaaaagcagagcaaatgtttggagagatggaagtttggaatgcaatatcagaacgtgatcgtcttgaaatctatgaagatgttttgttctttctttcaaaaaaagaaaaggaacaagcaaagcagttgcgaaagagaaattgggaagccttaaaaaacatacttgacaacatggctaatgtaacatactctaccacttggtctgaagcccagcagtatctgatggataatccaacttttgcagaagatgaggagttacaaaatatggacaaagaagatgcattaatttgctttgaagaacacattcgggctttagaaaaggaggaagaagaagaaaaacagaagagtttgctgagagaaaggagacgacagcgaaaaaatagggaatctttccagatatttttagatgaattacatgaacatggacaactgcattctatgtcatcttggatggaattgtatccaactattagttctgatattagattcactaatatgcttggtcagcctggatcaactgcacttgatcttttcaagttttatgttgaggatcttaaagcacgttatcatgacgagaagaagataataaaagacattctaaaggataaaggatttgtagttgaagtaaacactacttttgaagattttgtggcgataatcagttcaactaaaagatcaactacattagatgctggaaatatcaaattggctttcaatagtttactagaaaaggcagaagcccgtgaacgtgaaagagaaaaagaagaggctcggaagatgaaacgaaaagaatctgcatttaagagtatgttaaaacaagctgctcctccgatagaattggatgctgtctgggaagatatccgtgagagatttgtaaaagagccagcatttgaggacataactctagaatctgaaagaaaacgaatatttaaagattttatgcatgtgcttgagcatgaatgtcagcatcatcattcaaagaacaagaaacattctaagaaatctaaaaaacatcataggaaacgttcccgctctcgatcggggtcagattcagatgatgatgatagccattcaaagaaaaaaagacagcgatcagagtctcgttctgcttcagaacattcttctagtgcagagtctgagagaagttataaaaagtcaaaaaagcataagaagaaaagtaagaagaggagacataaatctgactctccagaatccgatgctgagcgagagaaggataaaaaagaaaaagatcgggaaagtgaaaaagacagaactagacaaagatcagaatcaaaacacaaatcgcctaagaaaaagactggaaaggattctggtaattgggatacttctggcagcgaactgagtgaaggggaattggaaaagcgcagaagaacccttttggagcaactggatgatgatcaataaattataccaaatatatgtttacagtatgatttaaagtctgattcagaccagggactctattttaagttcaactgaaataacactgggttttaattatatcacaggaaaaaaaaagtgcatttaagtattgttatcgtggactttataaaagcaaaggaaattgaaagtaacttttgattctgtatcaagaatcatattttcatacagtcataactgtctttctgtgaccctttcacagggcactgtaggatggattaaaggtggcaatttactgataactgcagatgtctctactttgttctaaaatctaagtcatgaggtgatttgatttactttatagaagctggattttgaagatctaatgaaaaattttttgataatatagtagtacaaaaaaagcaccagcaactgataaaaattgcttttttgtgcgctacccaactggttaaagccaatgtgatcttttatggtgaaactcctaagaaacaggtggttttgctggaaacttggtagacccttaattatagtggtgctaatgagcactactgtaatataaagccaccattattttttatcaaacatctgaatacattttacaaaggctattgtgagggcattattttgagcatctattttgaggtgatgtttaaaaaaactttaacatcaaatcaaattgtaaattaatttaaatatattgccttaaggacctactaaagaatgtgccaccagactttaagtgatagttgcaatatccttgtctaaaaaaaaaaaaaaagttgacttaaacattttctttaacagttgtcttttttttctaaattcagtctttctcttgcttttttttccctgctattgaggaagtattttgccttccctactcactgagaagtattgacttcgtggtacacattctaaagcatttctgatttgaatatttttgtacatttttatcaattattaaaccttctcttctagtgtgtactagtatttatttctacttaaactgctcagctctaaagaaattgtatgatcactttaaaggtactaaatccctgaaattttgcttcatcttacccacaccgctagtttactttccttttttaatatttaagaatattataaatcagtgcatttgaggtccctagatttgtttttcacctatgaattttttacagactattttagagaggctgtggtttgaagacagaatactctttacatgctaacttttgaaggttggtaatgtaatttatactattttccttcagtgcaggagattttttaagtaaataagtaaattttagcacctattcttcggtattatctgtgttattcttttaatgtgtacacttgaagagatcctatttcaaagttgggattttgaagaacaaaaagtttttttcttacccatcctagtgagttttgaaagtgggcctgaccagaatgtctctttcccattttgccccgtttgaattaaatataatgtctactctttaaaggctgaaggggtgggtgaggggattgtttctcattttgtctcccaagtcatttttctgctgtgaaatatgaccaggcttgtaggaagactcatcttggagaaaatgtgaagtaatcaaattgcttgagattagtctcctattgtatattagagccaaaacacataataactttggcaacagggagttgtctagactcaattttcagaggtcccattgtagtgagttaatattgctaatcatgtcaatcacttgacatggaagtcagtggcaaatctttaaagtatgcatttgatactggcaaatatatactactgatgtttcacaaaagaatcttagaatctgtagaaaacattaattacttccatgaattatttctaaagtataactttaaagttttgatttttctatttaaataaaaagctattgatgtgttttagcatgtcctcaaaatagattcctgtatttcttacagagataatcttactataaccgcaaatccctacaacacagtataaagtttccctgtagttcacccatgaaaattatttgacttaaaaacaaccatagtagtaagccaattgcaattcaaaatgcaacatccttgccataaaagatgtaacttaagtgactgtgatcctttgtctacctttcaggatcccatcaaatgggatttagttgctagaaagatacttgacagtctgaaggcacaggtgataagattttgttctctgtgaatatttttaaactaataggttatgtttttaaatcttcaatttggtaaaaaactgaaacgtcttggaatattggttctattagagttaaatatggtaaaacaggaaagcgtgtttattttcagataaggggaatttatacttttcattaaagtcttggagtcttaggaaaatgttgagggtttgtcttcccccagtgtcattaatactaatgaactattagatcaaattcacttatacatttaatatcatagttattcaaaatcaggactttaaatatttttttctcccagttcatatttctttgtgcgaaaattgaatttgtatgaaaagttagataattaagctaatcaagtatgaagtatacactcttcctaagtgaatttaaataatgtaatgcttttaaataaaagcagtggtcccaccacatttttttcagcatagtagctggcattttgttatcattagccagagtagcttcagcatataagttattgatgttttccaacttcaaaagtgcattttatgcctcccagtaaatttgataatgatttgtcacagctttgtcatcttttgacttttgcttatgggcctcacttcgtacaactataacatgaaaaaggattgtcctaaagtaagggaatcagttaatggtaggatgaagaaactgtaaaaactcctagaaaaaaacctgtgtgcatttttctggaaagttttcaaactgtgtaattcagttttcattcaattatataatttggttatatgctttaaaaaacatttgtctaaatgttcccggttttcttctggtcttagagtcagctgagtgctggctatgcagccactcgtatttttgcatccagaaaggagtaactccctttatatgaagatttttttttttaagcttagatgctatgtaagagaaaactatttgtaatcacatagtacccagggaggagtgatgaatgcttttttaaaaaaggatatttaagtatattatgtaatttaaatataaattatcaaactaaaaaacttcagcttttaaaactttctaaacaaaatgaagcaaagtacattaattccttctatcttaaatctgagactttttattttcccttgggtatatatttctctcagtgttaggtagatgttaattcaaccatcctacattctctatataaaattacactcattttacatgaaagcaaaataatgtcgttactttcatggaactgtgttctaacaggcttataatctcattctgtgcttctggtaatggcgtataccagtctgatgattcttaccatccttattcttacattactcttccaattgttttgattttaactggtggtcatgtaagttcctcggtggcagggatttatctggttcatttactgttatatatccttgtggaataggacagtgcctggcatataataggcacttttggaatgaatgtaaaatactagttgaaatatgtattcatctggcatccatggtacccatcatctgtattaaagggcttaaaaaagcatcattgcaataaaccatactaacccaccactaaagtcacagtcataattgaagtgcacccaaaataaggtccagtgactgtaccttagcttttacttcagacatgtccaaaacttgtgagaacatacaatttaaagttgaaaactcatcattttgggctatttttgaatagggctgaaatatggtgacatgtcaggcactcagttttttggagctgtcttaaaggtgaggtggaaagtgagagatgattttgctctaattacccacacattctccctaaccctccattttaagacacttagctataatagcttaagactatcaaaactgcttttgtgattctcagtaggatctagttcaaagccatctcagtgctagtgattggtaattgttaatttgatggtaattaccctacttgtaaagttgacattcatactggctaatcctccctgcccctagtcgtggacaatgaaacagtgagtggctggtgaattagatcagattcaaactaagccattccttgatgctattcttcactgctgttccttagggtatctaaatgtgttatttataaacatttttgggggctcctgcctgcaaacttcggtaggtgttggtcttccccacctctacaactgagccaaggacttgttctgaaaggtgagtaataaataagggaacaaggtttctattttctgtgtttgtaattaccagattttcacctctgtttatatattattctgatgtaaaagaacctcatagttatataaaattagaccttttgtaaataaatataatttattagaaaaaatggtatcttttactaaattggatttgtgtcagttttttcctttaagcaccactcaggcagcaagctctatgctgtgagagttgctggaggcccacgttatgttttctcagtgtaattcctctttttcttgataaaaaga

SEQ ID NO: 24961 - DNA, 3134 bp, Homo sapiens
actcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgctaaactaaacggatattcactctgaagtgggataaatgaagatgtggagtttcatgttcatgtagggcaggttttgccactatagtgagttttggtaccatacttgaaaaaagttggctttcagagggttttggtttccagaattgtgggtaaaggattgaggaccttgtgtacacttggtgaccatataacatttaaactactcccgtagtctcggttgctgatctcttttacaatttatagcaagctcggggaactgagaccactaaaagttttgctaagaatatgagtcagaggcttgaggattatacatagcagccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatggaatgttaacggaattaaagtatagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacagaaaaagaagaaaaagaagaagcaagatcaaagtacaaagaggctaaggaatcctttcagcgttttcttgaaaatcatgagaaaatgacttctacaaccagatacaaaaaagcagagcaaatgtttggagagatggaagtttggaatgcaatatcagaacgtgatcgtcttgaaatctatgaagatgttttgttctttctttcaaaaaaagaaaaggaacaagcaaagcagttgcgaaagagaaattgggaagccttaaaaaacatacttgacaacatggctaatgtaacatactctaccacttggtctgaagcccagcagtatctgatggataatccaacttttgcagaagatgaggagttacaaaatatggacaaagaagatgcattaatttgctttgaagaacacattcgggctttagaaaaggaggaagaagaagaaaaacagaagagtttgctgagagaaaggagacgacagcgaaaaaatagggaatctttccagatatttttagatgaattacatgaacatggacaactgcattctatgtcatcttggatggaattgtatccaactattagttctgatattagattcactaatatgcttggtcagcctggatcaactgcacttgatcttttcaagttttatgttgaggatcttaaagcacgttatcatgacgagaagaagataataaaagacattctaaaggataaaggatttgtagttgaagtaaacactacttttgaagattttgtggcgataatcagttcaactaaaagatcaactacattagatgctggaaatatcaaattggctttcaatagtttactagaaaaggcagaagcccgtgaacgtgaaagagaaaaagaagaggctcggaagatgaaacgaaaagaatctgcatttaagagtatgttaaaacaagctgctcctccgatagaattggatgctgtctgggaagatatccgtgagagatttgtaaaagagccagcatttgaggacataactctagaatctgaaagaaaacgaatatttaaagattttatgcatgtgcttgagcatgaatgtcagcatcatcattcaaagaacaagaaacattctaagaaatctaaaaaacatcataggaaacgttcccgctctcgatcggggtcagattcagatgatgatgatagccattcaaagaaaaaaagacagcgatcagagtctcgttctgcttcagaacattcttctagtgcagagtctgagagaagttataaaaagtcaaaaaagcataagaagaaaagtaagaagaggagacataaatctgactctccagaatccgatgctgagcgagagaaggataaaaaagaaaaagatcgggaaagtgaaaaagacagaactagacaaagatcagaatcaaaacacaaatcgcctaagaaaaagactggaaaggattctggtaattgggatacttctggcagcgaactgagtgaaggggaattggaaaagcgcagaagaacccttttggagcaactggatgatgatcaataa

SEQ ID NO: 24962 - DNA, 1358 bp, Homo sapiens
tctgagcccgacgatgaggccggggacgggagctgagcgtggaggcctcatggtgagtgaaatggagagccatcctccctcgcagggtcctggggacggggagcggagattgtccggctcaagcctctgctccggctcttgggtctctgctgacggcttcctgaggagacggccctcgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatgcaatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacag

SEQ ID NO: 24963 - DNA, 3044 bp, Homo sapiens
ggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaa

SEQ ID NO: 24964 - DNA, 2920 bp, Homo sapiens
ggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtc

SEQ ID NO: 24965 - DNA, 7273 bp, Homo sapiens
ggcgctgggaacgcggagcggacgcagtctggccgccattgcgctgcggggaaagcggcctcttgtgtgagggcctgtgggattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 24966 - DNA, 7253 bp, Homo sapiens
cggagcggacgcagtctggccgccattgcgctgcggggaaagcggcctcttgtgtgagggcctgtgggattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagctactcagaagttggcagcttgcagcaagcctctcatacaacaggcgccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagg

SEQ ID NO: 24967 - DNA, 1063 bp, Homo sapiens
tgtgaccagaaaatggaggcgaatctgtatttccagttaactgctcagaagagagatgctgaagagctgtagtcgtgcatccttctcaccctccgttagaaagcctcctctcatcctcagaagactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaatattgacttgaagctgaaagaaaagccttagttggccatgctggaagaagaggatgcttttctg

SEQ ID NO: 24968 - DNA, 4308 bp, Homo sapiens
gaccagaaaatggaggcgaatctgtatttccagttaactgctcagaagagagatgctgaagagctgtagtcgtgcatccttctcaccctccgttagaaagcctcctctcatcctcagaagactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaaactggatgaagaactgagggaagcatcagaggcagctaaaactagctgcctttacaatgatccagaaatgtcttctatggagaaggatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagtgatactttgtcccttagactggtgtttaccagtaagatacctttaatccactgttaagtatgagtggatttgtttccatagattagctggatttccttttggtgattgcattaggtttaaagtacacaggtctcaactctccccaggaaagtttcccctgtttgactccacctttaaaatcctaagcctgactaggacagccacaaaccacacaaggtgtaaaaccatcatcagctaagtgcccgttttgttcttgtttaccagaatctcctttaacttctcaaagggaagccgggctttctaatccacgtcaactttattttagttgtcaaattgggcattatattttatgtaaattggtcttttaacatcattttcctgatgaatgttggtgaccaccacattgtgaaatttaagaatccgtgttgcatgtttggtagctctctgagtttcaggccataaactcagctccagaggttaccttttaagtgccaagaactcaagtgcaaggtggcctactcaaaaatcatttggtagcattcagttattcatgaattcctctctcgcatgcattataaaaagtgatctgctttaaaacaccgtaatctgatcataggcttaaaattaaatatgagtattactttcatgtacaaaatatttcctttatagtcttcatatgccctttaaaatgccaacaagatttcaagtctgtaggcctctagtgaggtggggtggcaaaccacagctaagtctcgctcaccactgcaagctaagaatggtttttacattttgggttggaaaaattttttttgaatatttcatgacacatgaaaattattcaaatgttagtgccgataaataaagtggtactgaaacacagccacacaaacttgtttttgtactgtctacagctactttcacactacagccgcagagctgagcagttcagcagaccgtatgtcccacaatgcctaaaacattgactatgtttacagaaaaagtttgctgacccctgctctagcaaacgcatcctttcctactccaccccaatttgtatttagatagtttctctaacagaacggacaaatgaggctgcaaactaatttatttttgtcaaaaatcaatgttttgacatccacagacagtgaaataaaagaaatggcttgctgaaaaacatgaggagtcctagccacaaaatcactgcttaggttgcaattgccaaaatgaagccttcttagaagcacttctttagtatatacaggtgttggctgaagtccgtgcctcactctgggaaccattcttagtctccagtgtctcctattacaaagaagctggcagaaataaaaatgaaggggtgagagcggttccaccctagtctcatggtggaaaattcattggggagagctgtccaggatatttggagtcctgggtagaaggagcttgtaactactttaaagtcgacatctttgcacaggtgattgagtttctctgacctcattgcttcacctctgtctcctcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttggtaaataaattctccataatgtagattaataatataaaagtctttaatgacacaatatatctatatagcctcactgtataattcagaaataaaaattgattctgca

SEQ ID NO: 24969 - DNA, 12584 bp, Homo sapiens
ggagggagcagtcggtcgctgcgccccggcgggccactttcccgggaccccgctcgtcttccttgggccgagattttccactgcgcccctccgagtacccgggttccaaacccctagccacgacatggaagaatttttgcaacgcgccaaatctaaactgaatcgaagcaaacgcttggagaaggtccatgtggttattgggcctaaatcgtgtgacttggattctctcatttctaccttcacatatgcttactttctagacaaggtcagtccaccaggggttctgtgtttaccagtgctgaacataccaagaactgaattcaactacttcaccgagacgaggtttattttagaagagctaaatatttccgaatcattccacatattccgggatgaaattaacctgcatcagctaaatgatgaagggaagttatcgataacacttgttggcagcagtgtgctggcgagtgaagacaaaactttagaatcagcagttgtcaaagtcattaatccggttgagcagagcgatgccaacgttgagttccgagagtcttcctcttctctcgtgctaaaggagattctccaagaggctcctgagctcatcaccgagcaactggctcatcgcctcagaggtagcattcttttcaagtggatgaccatggaatcagagaagatctcagagaagcaggaggaaattctttctatcctggaagaaaaatttcctaacttgcctccaagagaggacatcatcaacgtcctacaggagacccagttcagtgctcagggtttaagtattgaacagacaatgttgaaagatctaaaggagctgtcagatggagaaataaaagtggccattagtactgtgagcatgaaccttgagaattgtctatttcacagcaatattaccagtgacttgaaagcatttacagacaagtttggttttgatgtcctcatcctgttctccagctatctgtcagaggagcagcagccgagacgacagattgctgtgtactcagaaaacatggagctgtgcagtcagatttgctgtgagctggaagagtgtcagaacccttgcctagaactggagccctttgactgtggctgtgatgagatcctggtgtaccaacaagaggacccttcagtgacttgtgatcaggtggttctcgttgtcaaggaagtcatcaacaggaggtgtccagagatggtctccaatagccggacatcctcaacagaagccgtggcaggcagtgcccccctctcccaggggtcttctgggattatggaattgtatggttctgacatagagccacaacccagctctgtgaatttcatagagaaccctccagatctcaatgattctaaccaggctcaggtggatgccaatgtagaccttgttagcccagacagcggactggctaccattaggagcagccgctcatccaaggagagctctgttttcctcagtgacgacagccccgtgggagaaggtgctgggcctcaccacacccttctcccagggcttgactcctacagccccatccctgaaggggcggtggcggaggaacatgcatggtctggagaacacggtgagcacttcgacctcttcaattttgacccagcacccatggcttctgggcagtcccagcaatcttctcattctgcagactactccccagcagatgacttcttccccaacagtgacctgtcagaaggacagctccccgctgggcctgaaggacttgatggcatgggaaccaacatgtctaattattcatccagttcacttttgtcaggggctggcaaagatagccttgtggaacatgatgaggagtttgtccagagacaagacagtcccagagataactctgaaagaaatttgagcctgacagattttgtgggagatgaatccccttccccagaaaggctaaaaaatactggaaagaggatcccaccaacacccatgaatagtttagtagaaagctcgccatccactgaagaaccagcctcactctatacagaagatatgacccaaaaagcaactgacacaggtcacatggggccacctcagacccatgcacggtgcagcagctggtggggtggtttggaaattgactccaaaaatattgcagatgcgtggagttccagtgaacaggaatctgttttccagagccctgaatcatggaaagagcataagccaagctccattgataggagagcctcagattctgtatttcaaccaaagagcctcgaatttacaaagtcaggtccctgggagtctgaatttggtcagcctgaactgggtagcaatgatattcaagacaaaaatgaggaaagcttgccgttccagaacctgcccatggagaagtcacctttgccaaatacatctccccaaggaacaaaccacctgatagaagactttgcttctttgtggcattctggtcgctctcccacagccatgcccgagccctggggaaatcctacagatgatggtgaaccagcagctgtggcgccattcccagcctggagtgcatttggtaaagaagatcatgatgaagctttaaaaaatacctggaatttgcacccaacaagcagcaagacaccttctgttagggacccgaatgagtgggccatggcaaaaagtgggtttgccttttcttcttcagaactactggacaattcacccagtgagataaacaatgaagcagctccagaaatctggggcaagaaaaacaatgactccagggatcacatctttgcacctggaaatcccagttctgatctggatcacacatggactaattctaagccaccaaaagaagatcagaatggtttagtggatcctaaaactaggggcaaggtatatgaaaaggtagattcctggaacctttttgaggagaatatgaagaaaggagggtcagatgtcctagttccttgggaagattccttcttatcttacaaatgttctgattacagtgcatccaacctaggagaagattcggtgccttcccccttagataccaattattccacctcagactcttacacatcaccaacatttgctggagacgaaaaggaaactgaacacaagccatttgctaaagaggaaggttttgagtcaaaagatggtaactccacggcagaggagactgacattcctcctcagtcactgcaacagtcatctcgaaatcgaatcagttcaggtcctgggaacctagacatgtgggcttcacctcatacagataacagttctgaaataaataccactcacaacctggatgaaaatgaactcaagacagagcacacagatggtaagaatatctccatggaggatgacgtcggggaaagcagccagtccagttacgacgaccccagcatgatgcaactgtacaatgaaacaaaccgacaactcacacttttgcacagcagcaccaactcccggcagacggcccctgacagtctcgacttgtggaacagagtgattttggaggatactcagtccactgcaacgatctcagatatggacaatgatttggactgggatgactgcagtgggggtgcggcaatccccagtgatggtcaaacagaaggatacatggctgaaggttccgagccggaaacccgatttacagtgagacagctggaaccctggggcttggagtatcaggaagcaaatcaggtagattgggagctccctgcctctgatgagcataccaaggacagtgctcccagtgaacatcacacattgaatgagaaaagtgggcagctaattgcaaacagtatttgggattctgtcatgagagataaagacatgtcatcattcatgttaccaggctcctcacatatcacagattcagagcaaagggaattgcctcctgaaatccccagccattcagcaaatgttaaagacactcattccccagatgcgccagcagcctctggaaccagtgaatcagaggcacttatatctcatcttgacaagcaggacacagagagggaaaccctgcaaagtgatgcagcatccttggcgactaggcttgagaatccagggtattttccacacccagatccatggaaaggtcatggcgatggacaaagtgaaagtgagaaggaagcccagggagccactgacagggggcaccttgatgaagaggaggtgatcgcctctggtgtggagaatgcctcagggatttctgaaaaagggcagagtgaccaggaactgtcttctctggttgcatctgaacatcaggaaatctgcattaaatcaggcaaaatcagctctcttgctgtcactttcagtcctcaaaccgaggaaccagaggaagttttagagtatgaggaggggtcttacaatctagactcccgtgatgtgcaaacagggatgtccgcagataacctgcagccaaaagatacccatgaaaaacacctcatgagtcaaagaaattcaggtgaaactactgagacttcagatgggatgaatttcacaaaatatgtatctgtacctgaaaaggatcttgagaaaactgaagaatgtaactttctagagccagagaacgtgggtggagggccacctcacagagttccccgaagtcttgattttggggacgtccctatagacagtgatgtgcatgtcagcagcacatgttctgagataaccaaaaatcttgacgttaaggggtctgaaaatagccttccaggagccggttcgtctggaaattttgacagagatactatttctagtgagtatactcattcaagtgcatcaagtcctgagttaaatgactcttcagttgcactgtcctcctggggccagcaacccagttctgggtatcaagaagaaaaccaaggcaactggagtgaacagaatcaccaagaatctgaactaattaccactgatggccaagtagaaatagttaccaaagtgaaggatttagagaaaaacagaataaatgagtttgaaaagagctttgatcgcaaaactcctacatttttagagatctggaatgactcagttgatggtgattccttttcctctttatccagtcctgaaacaggcaaatattctgaacattcagggacacatcaggaaagcaatctaattgctagctaccaggagaaaaatgaacatgacatttctgcaactgtgcagccagaggatgccagggtcatttcaacaagctcaggttctgatgatgacagtgtcggtggtgaagagtcaatagaggaagagatccaggtggccaactgccacgttgctgaggatgaatccagagcttgggattcattgaatgaatctaataagttcttggtcacagctgatcctaagtctgaaaatatttatgactacctagacagctcagagccagcagagaatgagaataagtcaaacccattctgtgacaatcaacaaagcagccctgatccctggactttctcaccattaacggagactgaaatgcagattacagcagtggagaaggagaagagatcttctccagaaacagggacaacaggagatgttgcatggcaaatatctcccaaagcttcgttcccaaagaacgaagataattctcaactggaaatgctgggcttctcagctgatagcactgagtggtggaaggcctcaccccaggaagggagactaattgaaagtccatttgaaagggagctgtctgactccagtggtgtgttggagataaattcttcagtacaccaaaatgccagtccctggggagtaccagttcagggtgatattgagcccgtggaaacacactatactaatccttttagtgacaaccatcagtcaccctttctggaaggtaatgggaagaactcccatgagcaactctggaacattcaaccaaggcagccagacccagatgctgacaagttcagccagcttgtaaaattagaccaaattaaagaaaaggactcaagagagcaaacctttgtgtctgctgctggtgatgagctgactcctgaaacacctacccaagagcagtgtcaggacaccatgctgccagtctgtgatcatccggacacagcctttactcacgcagaggaaaatagttgtgttacatctaatgtttcaactaatgaaggtcaagaaacaaatcagtgggaacaagaaaaatcatacctaggtgagatgacaaattcaagcattgccacagaaaattttcctgctgtcagttctcccacccaactgataatgaagccaggctctgaatgggatggctctaccccaagtgaggactcccgaggtacctttgtgccagatattttacatggcaactttcaagagggtgggcagctggcctctgccgcgcctgacttgtggatagatgctaagaagcccttcagtttgaaagcagatggtgagaatcctgatatcctgacgcactgcgaacatgacagcaattctcaggcttccgacagccctgatatatgtcacgattctgaagcaaagcaagagactgagaagcacctcagtgcttgcatgggacctgaagtggaatccagtgagctttgtctcactgagccagagatagatgaagaacccatttatgagcctggacgggagtttgtcccatccaatgcagaactcgattctgaaaacgcaactgtgctgcctccaattggctatcaagcagacataaagggctcctctcagcccgcctctcataaaggttcacctgaaccttctgaaataaacggtgacaacagtacaggtttacaagtatcagaaaaaggagccagcccagatatggcaccaattttggaaccagttgacagaagaatcccaaggattgaaaatgtggcaactagcatttttgtaactcaccaagagccaactccagaaggtgacggttcttggatatcagacagcttttctcctgaaagtcagcctggtgcaagagctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaatatcagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaagcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttggcactagaggaagcctctggtccagtcagccaatcacagaagagtaagagccgaggcagggctggcccggatgcagttacgttgcaggctgtcacccatgacaatgaatgggaaatgctttcaccacagcctgttcagaaaaacatgatccctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaaactggatgaagaactgagggaagcatcagaggcagctaaaactagctgcctttacaatgatccagaaatgtcttctatggagaaggatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagtgatactttgtcccttagactggtgtttaccagtaagatacctttaatccactgttaagtatgagtggatttgtttccatagattagctggatttccttttggtgattgcattaggtttaaagtacacaggtctcaactctccccaggaaagtttcccctgtttgactccacctttaaaatcctaagcctgactaggacagccacaaaccacacaaggtgtaaaaccatcatcagctaagtgcccgttttgttcttgtttaccagaatctcctttaacttctcaaagggaagccgggctttctaatccacgtcaactttattttagttgtcaaattgggcattatattttatgtaaattggtcttttaacatcattttcctgatgaatgttggtgaccaccacattgtgaaatttaagaatccgtgttgcatgtttggtagctctctgagtttcaggccataaactcagctccagaggttaccttttaagtgccaagaactcaagtgcaaggtggcctactcaaaaatcatttggtagcattcagttattcatgaattcctctctcgcatgcattataaaaagtgatctgctttaaaacaccgtaatctgatcataggcttaaaattaaatatgagtattactttcatgtacaaaatatttcctttatagtcttcatatgccctttaaaatgccaacaagatttcaagtctgtaggcctctagtgaggtggggtggcaaaccacagctaagtctcgctcaccactgcaagctaagaatggtttttacattttgggttggaaaaattttttttgaatatttcatgacacatgaaaattattcaaatgttagtgccgataaataaagtggtactgaaacacagccacacaaacttgtttttgtactgtctacagctactttcacactacagccgcagagctgagcagttcagcagaccgtatgtcccacaatgcctaaaacattgactatgtttacagaaaaagtttgctgacccctgctctagcaaacgcatcctttcctactccaccccaatttgtatttagatagtttctctaacagaacggacaaatgaggctgcaaactaatttatttttgtcaaaaatcaatgttttgacatccacagacagtgaaataaaagaaatggcttgctgaaaaacatgaggagtcctagccacaaaatcactgcttaggttgcaattgccaaaatgaagccttcttagaagcacttctttagtatatacaggtgttggctgaagtccgtgcctcactctgggaaccattcttagtctccagtgtctcctattacaaagaagctggcagaaataaaaatgaaggggtgagagcggttccaccctagtctcatggtggaaaattcattggggagagctgtccaggatatttggagtcctgggtagaaggagcttgtaactactttaaagtcgacatctttgcacaggtgattgagtttctctgacctcattgcttcacctctgtctcctcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttggtaaataaattctccataatgtagattaataatataaaagtctttaatgacacaatatatctatatagcctcactgtataattcagaaataaaaattgattctgc

SEQ ID NO: 24970 - DNA, 9162 bp, Homo sapiens
aggaacttgatgcataggatgaaggaaagtgagaatcgaagcaaacgcttggagaaggtccatgtggttattgggcctaaatcgtgtgacttggattctctcatttctaccttcacatatgcttactttctagacaaggtcagtccaccaggggttctgtgtttaccagtgctgaacataccaagaactgaattcaactacttcaccgagacgaggtttattttagaagagctaaatatttccgaatcattccacatattccgggatgaaattaacctgcatcagctaaatgatgaagggaagttatcgataacacttgttggcagcagtgtgctggcgagtgaagacaaaactttagaatcagcagttgtcaaagtcattaatccggttgagcagagcgatgccaacgttgagttccgagagtcttcctcttctctcgtgctaaaggagattctccaagaggctcctgagctcatcaccgagcaactggctcatcgcctcagaggtagcattcttttcaagtggatgaccatggaatcagagaagatctcagagaagcaggaggaaattctttctatcctggaagaaaaatttcctaacttgcctccaagagaggacatcatcaacgtcctacaggagacccagttcagtgctcagggtttaagtattgaacagacaatgttgaaagatctaaaggagctgtcagatggagaaataaaagtggccattagtactgtgagcatgaaccttgagaattgtctatttcacagcaatattaccagtgacttgaaagcatttacagacaagtttggttttgatgtcctcatcctgttctccagctatctgtcagaggagcagcagccgagacgacagattgctgtgtactcagaaaacatggagctgtgcagtcagatttgctgtgagctggaagagtgtcagaacccttgcctagaactggagccctttgactgtggctgtgatgagatcctggtgtaccaacaagaggacccttcagtgacttgtgatcaggtggttctcgttgtcaaggaagtcatcaacaggaggtgtccagagatggtctccaatagccggacatcctcaacagaagccgtggcaggcagtgcccccctctcccaggggtcttctgggattatggaattgtatggttctgacatagagccacaacccagctctgtgaatttcatagagaaccctccagatctcaatgattctaaccaggctcaggtggatgccaatgtagaccttgttagcccagacagcggactggctaccattaggagcagccgctcatccaaggagagctctgttttcctcagtgacgacagccccgtgggagaaggtgctgggcctcaccacacccttctcccagggcttgactcctacagccccatccctgaaggggcggtggcggaggaacatgcatggtctggagaacacggtgagcacttcgacctcttcaattttgacccagcacccatggcttctgggcagtcccagcaatcttctcattctgcagactactccccagcagatgacttcttccccaacagtgacctgtcagaaggacagctccccgctgggcctgaaggacttgatggcatgggaaccaacatgtctaattattcatccagttcacttttgtcaggggctggcaaagatagccttgtggaacatgatgaggagtttgtccagagacaagacagtcccagagataactctgaaagaaatttgagcctgacagattttgtgggagatgaatccccttccccagaaaggctaaaaaatactggaaagaggatcccaccaacacccatgaatagtttagtagaaagctcgccatccactgaagaaccagcctcactctatacagaagatatgacccaaaaagcaactgacacaggtcacatggggccacctcagacccatgcacggtgcagcagctggtggggtggtttggaaattgactccaaaaatattgcagatgcgtggagttccagtgaacaggaatctgttttccagagccctgaatcatggaaagagcataagccaagctccattgataggagagcctcagattctgtatttcaaccaaagagcctcgaatttacaaagtcaggtccctgggagtctgaatttggtcagcctgaactgggtagcaatgatattcaagacaaaaatgaggaaagcttgccgttccagaacctgcccatggagaagtcacctttgccaaatacatctccccaaggaacaaaccacctgatagaagactttgcttctttgtggcattctggtcgctctcccacagccatgcccgagccctggggaaatcctacagatgatggtgaaccagcagctgtggcgccattcccagcctggagtgcatttggtaaagaagatcatgatgaagctttaaaaaatacctggaatttgcacccaacaagcagcaagacaccttctgttagggacccgaatgagtgggccatggcaaaaagtgggtttgccttttcttcttcagaactactggacaattcacccagtgagataaacaatgaagcagctccagaaatctggggcaagaaaaacaatgactccagggatcacatctttgcacctggaaatcccagttctgatctggatcacacatggactaattctaagccaccaaaagaagatcagaatggtttagtggatcctaaaactaggggcaaggtatatgaaaaggtagattcctggaacctttttgaggagaatatgaagaaaggagggtcagatgtcctagttccttgggaagattccttcttatcttacaaatgttctgattacagtgcatccaacctaggagaagattcggtgccttcccccttagataccaattattccacctcagactcttacacatcaccaacatttgctggagacgaaaaggaaactgaacacaagccatttgctaaagaggaaggttttgagtcaaaagatggtaactccacggcagaggagactgacattcctcctcagtcactgcaacagtcatctcgaaatcgaatcagttcaggtcctgggaacctagacatgtgggcttcacctcatacagataacagttctgaaataaataccactcacaacctggatgaaaatgaactcaagacagagcacacagatggtaagaatatctccatggaggatgacgtcggggaaagcagccagtccagttacgacgaccccagcatgatgcaactgtacaatgaaacaaaccgacaactcacacttttgcacagcagcaccaactcccggcagacggcccctgacagtctcgacttgtggaacagagtgattttggaggatactcagtccactgcaacgatctcagatatggacaatgatttggactgggatgactgcagtgggggtgcggcaatccccagtgatggtcaaacagaaggatacatggctgaaggttccgagccggaaacccgatttacagtgagacagctggaaccctggggcttggagtatcaggaagcaaatcaggtagattgggagctccctgcctctgatgagcataccaaggacagtgctcccagtgaacatcacacattgaatgagaaaagtgggcagctaattgcaaacagtatttgggattctgtcatgagagataaagacatgtcatcattcatgttaccaggctcctcacatatcacagattcagagcaaagggaattgcctcctgaaatccccagccattcagcaaatgttaaagacactcattccccagatgcgccagcagcctctggaaccagtgaatcagaggcacttatatctcatcttgacaagcaggacacagagagggaaaccctgcaaagtgatgcagcatccttggcgactaggcttgagaatccagggtattttccacacccagatccatggaaaggtcatggcgatggacaaagtgaaagtgagaaggaagcccagggagccactgacagggggcaccttgatgaagaggaggtgatcgcctctggtgtggagaatgcctcagggatttctgaaaaagggcagagtgaccaggaactgtcttctctggttgcatctgaacatcaggaaatctgcattaaatcaggcaaaatcagctctcttgctgtcactttcagtcctcaaaccgaggaaccagaggaagttttagagtatgaggaggggtcttacaatctagactcccgtgatgtgcaaacagggatgtccgcagataacctgcagccaaaagatacccatgaaaaacacctcatgagtcaaagaaattcaggtgaaactactgagacttcagatgggatgaatttcacaaaatatgtatctgtacctgaaaaggatcttgagaaaactgaagaatgtaactttctagagccagagaacgtgggtggagggccacctcacagagttccccgaagtcttgattttggggacgtccctatagacagtgatgtgcatgtcagcagcacatgttctgagataaccaaaaatcttgacgttaaggggtctgaaaatagccttccaggagccggttcgtctggaaattttgacagagatactatttctagtgagtatactcattcaagtgcatcaagtcctgagttaaatgactcttcagttgcactgtcctcctggggccagcaacccagttctgggtatcaagaagaaaaccaaggcaactggagtgaacagaatcaccaagaatctgaactaattaccactgatggccaagtagaaatagttaccaaagtgaaggatttagagaaaaacagaataaatgagtttgaaaagagctttgatcgcaaaactcctacatttttagagatctggaatgactcagttgatggtgattccttttcctctttatccagtcctgaaacaggcaaatattctgaacattcagggacacatcaggaaagcaatctaattgctagctaccaggagaaaaatgaacatgacatttctgcaactgtgcagccagaggatgccagggtcatttcaacaagctcaggttctgatgatgacagtgtcggtggtgaagagtcaatagaggaagagatccaggtggccaactgccacgttgctgaggatgaatccagagcttgggattcattgaatgaatctaataagttcttggtcacagctgatcctaagtctgaaaatatttatgactacctagacagctcagagccagcagagaatgagaataagtcaaacccattctgtgacaatcaacaaagcagccctgatccctggactttctcaccattaacggagactgaaatgcagattacagcagtggagaaggagaagagatcttctccagaaacagggacaacaggagatgttgcatggcaaatatctcccaaagcttcgttcccaaagaacgaagataattctcaactggaaatgctgggcttctcagctgatagcactgagtggtggaaggcctcaccccaggaagggagactaattgaaagtccatttgaaagggagctgtctgactccagtggtgtgttggagataaattcttcagtacaccaaaatgccagtccctggggagtaccagttcagggtgatattgagcccgtggaaacacactatactaatccttttagtgacaaccatcagtcaccctttctggaaggtaatgggaagaactcccatgagcaactctggaacattcaaccaaggcagccagacccagatgctgacaagttcagccagcttgtaaaattagaccaaattaaagaaaaggactcaagagagcaaacctttgtgtctgctgctggtgatgagctgactcctgaaacacctacccaagagcagtgtcaggacaccatgctgccagtctgtgatcatccggacacagcctttactcacgcagaggaaaatagttgtgttacatctaatgtttcaactaatgaaggtcaagaaacaaatcagtgggaacaagaaaaatcatacctaggtgagatgacaaattcaagcattgccacagaaaattttcctgctgtcagttctcccacccaactgataatgaagccaggctctgaatgggatggctctaccccaagtgaggactcccgaggtacctttgtgccagatattttacatggcaactttcaagagggtgggcagctggcctctgccgcgcctgacttgtggatagatgctaagaagcccttcagtttgaaagcagatggtgagaatcctgatatcctgacgcactgcgaacatgacagcaattctcaggcttccgacagccctgatatatgtcacgattctgaagcaaagcaagagactgagaagcacctcagtgcttgcatgggacctgaagtggaatccagtgagctttgtctcactgagccagagatagatgaagaacccatttatgagcctggacgggagtttgtcccatccaatgcagaactcgattctgaaaacgcaactgtgctgcctccaattggctatcaagcagacataaagggctcctctcagcccgcctctcataaaggttcacctgaaccttctgaaataaacggtgacaacagtacaggtttacaagtatcagaaaaaggagccagcccagatatggcaccaattttggaaccagttgacagaagaatcccaaggattgaaaatgtggcaactagcatttttgtaactcaccaagagccaactccagaaggtgacggttcttggatatcagacagcttttctcctgaaagtcagcctggtgcaagagctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaatatcagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaagcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttggcactagaggaagcctctggtccagtcagccaatcacagaagagtaagagccgaggcagggctggcccggatgcagttacgttgcaggctgtcacccatgacaatgaatgggaaatgctttcaccacagcctgttcagaaaaacatgatccctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggtagtcgaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaattat

SEQ ID NO: 24971 - DNA, 903 bp, Homo sapiens
attgacatcaatgtggatgaacttgatacccccgatgaagcagattcttttgagtacactggccatgatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggagattcaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaagtacgatgaagagagatcttataagagaagtgtgagaactagctgcctttacaatgatccagaaatgtcttctatggagaaggatattgacttgaagctgaaagaaaagccttagttggccatgctggaagaagaggatgcttttctggttcatggttctgttgaaacatatctacctgaaagagacagggctgatgttacctttttccactttgcactacctggtgccattcta

SEQ ID NO: 24972 - DNA, 7434 bp, Homo sapiens
tttccagagccctgaatcatggaaagagcataagccaagctccattgataggagagcctcagattctgtatttcaaccaaagagcctcgaatttacaaagtcaggtccctgggagtctgaatttggtcagcctgaactgggtagcaatgatattcaagacaaaaatgaggaaagcttgccgttccagaacctgcccatggagaagtcacctttgccaaatacatctccccaaggaacaaaccacctgatagaagactttgcttctttgtggcattctggtcgctctcccacagccatgcccgagccctggggaaatcctacagatgatggtgaaccagcagctgtggcgccattcccagcctggagtgcatttggtaaagaagatcatgatgaagctttaaaaaatacctggaatttgcacccaacaagcagcaagacaccttctgttagggacccgaatgagtgggccatggcaaaaagtgggtttgccttttcttcttcagaactactggacaattcacccagtgagataaacaatgaagcagctccagaaatctggggcaagaaaaacaatgactccagggatcacatctttgcacctggaaatcccagttctgatctggatcacacatggactaattctaagccaccaaaagaagatcagaatggtttagtggatcctaaaactaggggcaaggtatatgaaaaggtagattcctggaacctttttgaggagaatatgaagaaaggagggtcagatgtcctagttccttgggaagattccttcttatcttacaaatgttctgattacagtgcatccaacctaggagaagattcggtgccttcccccttagataccaattattccacctcagactcttacacatcaccaacatttgctggagacgaaaaggaaactgaacacaagccatttgctaaagaggaaggttttgagtcaaaagatggtaactccacggcagaggagactgacattcctcctcagtcactgcaacagtcatctcgaaatcgaatcagttcaggtcctgggaacctagacatgtgggcttcacctcatacagataacagttctgaaataaataccactcacaacctggatgaaaatgaactcaagacagagcacacagatggtaagaatatctccatggaggatgacgtcggggaaagcagccagtccagttacgacgaccccagcatgatgcaactgtacaatgaaacaaaccgacaactcacacttttgcacagcagcaccaactcccggcagacggcccctgacagtctcgacttgtggaacagagtgattttggaggatactcagtccactgcaacgatctcagatatggacaatgatttggactgggatgactgcagtgggggtgcggcaatccccagtgatggtcaaacagaaggatacatggctgaaggttccgagccggaaacccgatttacagtgagacagctggaaccctggggcttggagtatcaggaagcaaatcaggtagattgggagctccctgcctctgatgagcataccaaggacagtgctcccagtgaacatcacacattgaatgagaaaagtgggcagctaattgcaaacagtatttgggattctgtcatgagagataaagacatgtcatcattcatgttaccaggctcctcacatatcacagattcagagcaaagggaattgcctcctgaaatccccagccattcagcaaatgttaaagacactcattccccagatgcgccagcagcctctggaaccagtgaatcagaggcacttatatctcatcttgacaagcaggacacagagagggaaaccctgcaaagtgatgcagcatccttggcgactaggcttgagaatccagggtattttccacacccagatccatggaaaggtcatggcgatggacaaagtgaaagtgagaaggaagcccagggagccactgacagggggcaccttgatgaagaggaggtgatcgcctctggtgtggagaatgcctcagggatttctgaaaaagggcagagtgaccaggaactgtcttctctggttgcatctgaacatcaggaaatctgcattaaatcaggcaaaatcagctctcttgctgtcactttcagtcctcaaaccgaggaaccagaggaagttttagagtatgaggaggggtcttacaatctagactcccgtgatgtgcaaacagggatgtccgcagataacctgcagccaaaagatacccatgaaaaacacctcatgagtcaaagaaattcaggtgaaactactgagacttcagatgggatgaatttcacaaaatatgtatctgtacctgaaaaggatcttgagaaaactgaagaatgtaactttctagagccagagaacgtgggtggagggccacctcacagagttccccgaagtcttgattttggggacgtccctatagacagtgatgtgcatgtcagcagcacatgttctgagataaccaaaaatcttgacgttaaggggtctgaaaatagccttccaggagccggttcgtctggaaattttgacagagatactatttctagtgagtatactcattcaagtgcatcaagtcctgagttaaatgactcttcagttgcactgtcctcctggggccagcaacccagttctgggtatcaagaagaaaaccaaggcaactggagtgaacagaatcaccaagaatctgaactaattaccactgatggccaagtagaaatagttaccaaagtgaaggatttagagaaaaacagaataaatgagtttgaaaagagctttgatcgcaaaactcctacatttttagagatctggaatgactcagttgatggtgattccttttcctctttatccagtcctgaaacaggcaaatattctgaacattcagggacacatcaggaaagcaatctaattgctagctaccaggagaaaaatgaacatgacatttctgcaactgtgcagccagaggatgccagggtcatttcaacaagctcaggttctgatgatgacagtgtcggtggtgaagagtcaatagaggaagagatccaggtggccaactgccacgttgctgaggatgaatccagagcttgggattcattgaatgaatctaataagttcttggtcacagctgatcctaagtctgaaaatatttatgactacctagacagctcagagccagcagagaatgagaataagtcaaacccattctgtgacaatcaacaaagcagccctgatccctggactttctcaccattaacggagactgaaatgcagattacagcagtggagaaggagaagagatcttctccagaaacagggacaacaggagatgttgcatggcaaatatctcccaaagcttcgttcccaaagaacgaagataattctcaactggaaatgctgggcttctcagctgatagcactgagtggtggaaggcctcaccccaggaagggagactaattgaaagtccatttgaaagggagctgtctgactccagtggtgtgttggagataaattcttcagtacaccaaaatgccagtccctggggagtaccagttcagggtgatattgagcccgtggaaacacactatactaatccttttagtgacaaccatcagtcaccctttctggaaggtaatgggaagaactcccatgagcaactctggaacattcaaccaaggcagccagacccagatgctgacaagttcagccagcttgtaaaattagaccaaattaaagaaaaggactcaagagagcaaacctttgtgtctgctgctggtgatgagctgactcctgaaacacctacccaagagcagtgtcaggacaccatgctgccagtctgtgatcatccggacacagcctttactcacgcagaggaaaatagttgtgttacatctaatgtttcaactaatgaaggtcaagaaacaaatcagtgggaacaagaaaaatcatacctaggtgagatgacaaattcaagcattgccacagaaaattttcctgctgtcagttctcccacccaactgataatgaagccaggctctgaatgggatggctctaccccaagtgaggactcccgaggtacctttgtgccagatattttacatggcaactttcaagagggtgggcagctggcctctgccgcgcctgacttgtggatagatgctaagaagcccttcagtttgaaagcagatggtgagaatcctgatatcctgacgcactgcgaacatgacagcaattctcaggcttccgacagccctgatatatgtcacgattctgaagcaaagcaagagactgagaagcacctcagtgcttgcatgggacctgaagtggaatccagtgagctttgtctcactgagccagagatagatgaagaacccatttatgagcctggacgggagtttgtcccatccaatgcagaactcgattctgaaaacgcaactgtgctgcctccaattggctatcaagcagacataaagggctcctctcagcccgcctctcataaaggttcacctgaaccttctgaaataaacggtgacaacagtacaggtttacaagtatcagaaaaaggagccagcccagatatggcaccaattttggaaccagttgacagaagaatcccaaggattgaaaatgtggcaactagcatttttgtaactcaccaagagccaactccagaaggtgacggttcttggatatcagacagcttttctcctgaaagtcagcctggtgcaagagctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaatatcagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaagcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttggcactagaggaagcctctggtccagtcagccaatcacagaagagtaagagccgaggcagggctggcccggatgcagttacgttgcaggctgtcacccatgacaatgaatgggaaatgctttcaccacagcctgttcagaaaaacatgatccctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggagattcaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagt

SEQ ID NO: 24973 - DNA, 12587 bp, Homo sapiens
ggagggagcagtcggtcgctgcgccccggcgggccactttcccgggaccccgctcgtcttccttgggccgagattttccactgcgcccctccgagtacccgggttccaaacccctagccacgacatggaagaatttttgcaacgcgccaaatctaaactgaatcgaagcaaacgcttggagaaggtccatgtggttattgggcctaaatcgtgtgacttggattctctcatttctaccttcacatatgcttactttctagacaaggtcagtccaccaggggttctgtgtttaccagtgctgaacataccaagaactgaattcaactacttcaccgagacgaggtttattttagaagagctaaatatttccgaatcattccacatattccgggatgaaattaacctgcatcagctaaatgatgaagggaagttatcgataacacttgttggcagcagtgtgctggcgagtgaagacaaaactttagaatcagcagttgtcaaagtcattaatccggttgagcagagcgatgccaacgttgagttccgagagtcttcctcttctctcgtgctaaaggagattctccaagaggctcctgagctcatcaccgagcaactggctcatcgcctcagaggtagcattcttttcaagtggatgaccatggaatcagagaagatctcagagaagcaggaggaaattctttctatcctggaagaaaaatttcctaacttgcctccaagagaggacatcatcaacgtcctacaggagacccagttcagtgctcagggtttaagtattgaacagacaatgttgaaagatctaaaggagctgtcagatggagaaataaaagtggccattagtactgtgagcatgaaccttgagaattgtctatttcacagcaatattaccagtgacttgaaagcatttacagacaagtttggttttgatgtcctcatcctgttctccagctatctgtcagaggagcagcagccgagacgacagattgctgtgtactcagaaaacatggagctgtgcagtcagatttgctgtgagctggaagagtgtcagaacccttgcctagaactggagccctttgactgtggctgtgatgagatcctggtgtaccaacaagaggacccttcagtgacttgtgatcaggtggttctcgttgtcaaggaagtcatcaacaggaggtgtccagagatggtctccaatagccggacatcctcaacagaagccgtggcaggcagtgcccccctctcccaggggtcttctgggattatggaattgtatggttctgacatagagccacaacccagctctgtgaatttcatagagaaccctccagatctcaatgattctaaccaggctcaggtggatgccaatgtagaccttgttagcccagacagcggactggctaccattaggagcagccgctcatccaaggagagctctgttttcctcagtgacgacagccccgtgggagaaggtgctgggcctcaccacacccttctcccagggcttgactcctacagccccatccctgaaggggcggtggcggaggaacatgcatggtctggagaacacggtgagcacttcgacctcttcaattttgacccagcacccatggcttctgggcagtcccagcaatcttctcattctgcagactactccccagcagatgacttcttccccaacagtgacctgtcagaaggacagctccccgctgggcctgaaggacttgatggcatgggaaccaacatgtctaattattcatccagttcacttttgtcaggggctggcaaagatagccttgtggaacatgatgaggagtttgtccagagacaagacagtcccagagataactctgaaagaaatttgagcctgacagattttgtgggagatgaatccccttccccagaaaggctaaaaaatactggaaagaggatcccaccaacacccatgaatagtttagtagaaagctcgccatccactgaagaaccagcctcactctatacagaagatatgacccaaaaagcaactgacacaggtcacatggggccacctcagacccatgcacggtgcagcagctggtggggtggtttggaaattgactccaaaaatattgcagatgcgtggagttccagtgaacaggaatctgttttccagagccctgaatcatggaaagagcataagccaagctccattgataggagagcctcagattctgtatttcaaccaaagagcctcgaatttacaaagtcaggtccctgggagtctgaatttggtcagcctgaactgggtagcaatgatattcaagacaaaaatgaggaaagcttgccgttccagaacctgcccatggagaagtcacctttgccaaatacatctccccaaggaacaaaccacctgatagaagactttgcttctttgtggcattctggtcgctctcccacagccatgcccgagccctggggaaatcctacagatgatggtgaaccagcagctgtggcgccattcccagcctggagtgcatttggtaaagaagatcatgatgaagctttaaaaaatacctggaatttgcacccaacaagcagcaagacaccttctgttagggacccgaatgagtgggccatggcaaaaagtgggtttgccttttcttcttcagaactactggacaattcacccagtgagataaacaatgaagcagctccagaaatctggggcaagaaaaacaatgactccagggatcacatctttgcacctggaaatcccagttctgatctggatcacacatggactaattctaagccaccaaaagaagatcagaatggtttagtggatcctaaaactaggggcaaggtatatgaaaaggtagattcctggaacctttttgaggagaatatgaagaaaggagggtcagatgtcctagttccttgggaagattccttcttatcttacaaatgttctgattacagtgcatccaacctaggagaagattcggtgccttcccccttagataccaattattccacctcagactcttacacatcaccaacatttgctggagacgaaaaggaaactgaacacaagccatttgctaaagaggaaggttttgagtcaaaagatggtaactccacggcagaggagactgacattcctcctcagtcactgcaacagtcatctcgaaatcgaatcagttcaggtcctgggaacctagacatgtgggcttcacctcatacagataacagttctgaaataaataccactcacaacctggatgaaaatgaactcaagacagagcacacagatggtaagaatatctccatggaggatgacgtcggggaaagcagccagtccagttacgacgaccccagcatgatgcaactgtacaatgaaacaaaccgacaactcacacttttgcacagcagcaccaactcccggcagacggcccctgacagtctcgacttgtggaacagagtgattttggaggatactcagtccactgcaacgatctcagatatggacaatgatttggactgggatgactgcagtgggggtgcggcaatccccagtgatggtcaaacagaaggatacatggctgaaggttccgagccggaaacccgatttacagtgagacagctggaaccctggggcttggagtatcaggaagcaaatcaggtagattgggagctccctgcctctgatgagcataccaaggacagtgctcccagtgaacatcacacattgaatgagaaaagtgggcagctaattgcaaacagtatttgggattctgtcatgagagataaagacatgtcatcattcatgttaccaggctcctcacatatcacagattcagagcaaagggaattgcctcctgaaatccccagccattcagcaaatgttaaagacactcattccccagatgcgccagcagcctctggaaccagtgaatcagaggcacttatatctcatcttgacaagcaggacacagagagggaaaccctgcaaagtgatgcagcatccttggcgactaggcttgagaatccagggtattttccacacccagatccatggaaaggtcatggcgatggacaaagtgaaagtgagaaggaagcccagggagccactgacagggggcaccttgatgaagaggaggtgatcgcctctggtgtggagaatgcctcagggatttctgaaaaagggcagagtgaccaggaactgtcttctctggttgcatctgaacatcaggaaatctgcattaaatcaggcaaaatcagctctcttgctgtcactttcagtcctcaaaccgaggaaccagaggaagttttagagtatgaggaggggtcttacaatctagactcccgtgatgtgcaaacagggatgtccgcagataacctgcagccaaaagatacccatgaaaaacacctcatgagtcaaagaaattcaggtgaaactactgagacttcagatgggatgaatttcacaaaatatgtatctgtacctgaaaaggatcttgagaaaactgaagaatgtaactttctagagccagagaacgtgggtggagggccacctcacagagttccccgaagtcttgattttggggacgtccctatagacagtgatgtgcatgtcagcagcacatgttctgagataaccaaaaatcttgacgttaaggggtctgaaaatagccttccaggagccggttcgtctggaaattttgacagagatactatttctagtgagtatactcattcaagtgcatcaagtcctgagttaaatgactcttcagttgcactgtcctcctggggccagcaacccagttctgggtatcaagaagaaaaccaaggcaactggagtgaacagaatcaccaagaatctgaactaattaccactgatggccaagtagaaatagttaccaaagtgaaggatttagagaaaaacagaataaatgagtttgaaaagagctttgatcgcaaaactcctacatttttagagatctggaatgactcagttgatggtgattccttttcctctttatccagtcctgaaacaggcaaatattctgaacattcagggacacatcaggaaagcaatctaattgctagctaccaggagaaaaatgaacatgacatttctgcaactgtgcagccagaggatgccagggtcatttcaacaagctcaggttctgatgatgacagtgtcggtggtgaagagtcaatagaggaagagatccaggtggccaactgccacgttgctgaggatgaatccagagcttgggattcattgaatgaatctaataagttcttggtcacagctgatcctaagtctgaaaatatttatgactacctagacagctcagagccagcagagaatgagaataagtcaaacccattctgtgacaatcaacaaagcagccctgatccctggactttctcaccattaacggagactgaaatgcagattacagcagtggagaaggagaagagatcttctccagaaacagggacaacaggagatgttgcatggcaaatatctcccaaagcttcgttcccaaagaacgaagataattctcaactggaaatgctgggcttctcagctgatagcactgagtggtggaaggcctcaccccaggaagggagactaattgaaagtccatttgaaagggagctgtctgactccagtggtgtgttggagataaattcttcagtacaccaaaatgccagtccctggggagtaccagttcagggtgatattgagcccgtggaaacacactatactaatccttttagtgacaaccatcagtcaccctttctggaaggtaatgggaagaactcccatgagcaactctggaacattcaaccaaggcagccagacccagatgctgacaagttcagccagcttgtaaaattagaccaaattaaagaaaaggactcaagagagcaaacctttgtgtctgctgctggtgatgagctgactcctgaaacacctacccaagagcagtgtcaggacaccatgctgccagtctgtgatcatccggacacagcctttactcacgcagaggaaaatagttgtgttacatctaatgtttcaactaatgaaggtcaagaaacaaatcagtgggaacaagaaaaatcatacctaggtgagatgacaaattcaagcattgccacagaaaattttcctgctgtcagttctcccacccaactgataatgaagccaggctctgaatgggatggctctaccccaagtgaggactcccgaggtacctttgtgccagatattttacatggcaactttcaagagggtgggcagctggcctctgccgcgcctgacttgtggatagatgctaagaagcccttcagtttgaaagcagatggtgagaatcctgatatcctgacgcactgcgaacatgacagcaattctcaggcttccgacagccctgatatatgtcacgattctgaagcaaagcaagagactgagaagcacctcagtgcttgcatgggacctgaagtggaatccagtgagctttgtctcactgagccagagatagatgaagaacccatttatgagcctggacgggagtttgtcccatccaatgcagaactcgattctgaaaacgcaactgtgctgcctccaattggctatcaagcagacataaagggctcctctcagcccgcctctcataaaggttcacctgaaccttctgaaataaacggtgacaacagtacaggtttacaagtatcagaaaaaggagccagcccagatatggcaccaattttggaaccagttgacagaagaatcccaaggattgaaaatgtggcaactagcatttttgtaactcaccaagagccaactccagaaggtgacggttcttggatatcagacagcttttctcctgaaagtcagcctggtgcaagagctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaatatcagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaagcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttggcactagaggaagcctctggtccagtcagccaatcacagaagagtaagagccgaggcagggctggcccggatgcagttacgttgcaggctgtcacccatgacaatgaatgggaaatgctttcaccacagcctgttcagaaaaacatgatccctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaaactggatgaagaactgagggaagcatcagaggcagctaaaactagctgcctttacaatgatccagaaatgtcttctatggagaaggatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagtgatactttgtcccttagactggtgtttaccagtaagatacctttaatccactgttaagtatgagtggatttgtttccatagattagctggatttccttttggtgattgcattaggtttaaagtacacaggtctcaactctccccaggaaagtttcccctgtttgactccacctttaaaatcctaagcctgactaggacagccacaaaccacacaaggtgtaaaaccatcatcagctaagtgcccgttttgttcttgtttaccagaatctcctttaacttctcaaagggaagccgggctttctaatccacgtcaactttattttagttgtcaaattgggcattatattttatgtaaattggtcttttaacatcattttcctgatgaatgttggtgaccaccacattgtgaaatttaagaatccgtgttgcatgtttggtagctctctgagtttcaggccataaactcagctccagaggttaccttttaagtgccaagaactcaagtgcaaggtggcctactcaaaaatcatttggtagcattcagttattcatgaattcctctctcgcatgcattataaaaagtgatctgctttaaaacaccgtaatctgatcataggcttaaaattaaatatgagtattactttcatgtacaaaatatttcctttatagtcttcatatgccctttaaaatgccaacaagatttcaagtctgtaggcctctagtgaggtggggtggcaaaccacagctaagtctcgctcaccactgcaagctaagaatggtttttacattttgggttggaaaaattttttttgaatatttcatgacacatgaaaattattcaaatgttagtgccgataaataaagtggtactgaaacacagccacacaaacttgtttttgtactgtctacagctactttcacactacagccgcagagctgagcagttcagcagaccgtatgtcccacaatgcctaaaacattgactatgtttacagaaaaagtttgctgacccctgctctagcaaacgcatcctttcctactccaccccaatttgtatttagatagtttctctaacagaacggacaaatgaggctgcaaactaatttatttttgtcaaaaatcaatgttttgacatccacagacagtgaaataaaagaaatggcttgctgaaaaacatgaggagtcctagccacaaaatcactgcttaggttgcaattgccaaaatgaagccttcttagaagcacttctttagtatatacaggtgttggctgaagtccgtgcctcactctgggaaccattcttagtctccagtgtctcctattacaaagaagctggcagaaataaaaatgaaggggtgagagcggttccaccctagtctcatggtggaaaattcattggggagagctgtccaggatatttggagtcctgggtagaaggagcttgtaactactttaaagtcgacatctttgcacaggtgattgagtttctctgacctcattgcttcacctctgtctcctcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttggtaaataaattctccataatgtagattaataatataaaagtctttaatgacacaatatatctatatagcctcactgtataattcagaaataaaaattgattctgc

SEQ ID NO: 24974 - DNA, 5674 bp, Homo sapiens
gctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaatatcagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaagcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttggcactagaggaagcctctggtccagtcagccaatcacagaagagtaagagccgaggcagggctggcccggatgcagttacgttgcaggctgtcacccatgacaatgaatgggaaatgctttcaccacagcctgttcagaaaaacatgatccctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggtaagctaagatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaagtacgatgaagagagatcttataagagaagtgtgagaactagctgcctttacaatgatccagaaatgtcttctatggagaaggatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagtgatactttgtcccttagactggtgtttaccagtaagatacctttaatccactgttaagtatgagtggatttgtttccatagattagctggatttccttttggtgattgcattaggtttaaagtacacaggtctcaactctccccaggaaagtttcccctgtttgactccacctttaaaatcctaagcctgactaggacagccacaaaccacacaaggtgtaaaaccatcatcagctaagtgcccgttttgttcttgtttaccagaatctcctttaacttctcaaagggaagccgggctttctaatccacgtcaactttattttagttgtcaaattgggcattatattttatgtaaattggtcttttaacatcattttcctgatgaatgttggtgaccaccacattgtgaaatttaagaatccgtgttgcatgtttggtagctctctgagtttcaggccataaactcagctccagaggttaccttttaagtgccaagaactcaagtgcaaggtggcctactcaaaaatcatttggtagcattcagttattcatgaattcctctctcgcatgcattataaaaagtgatctgctttaaaacaccgtaatctgatcataggcttaaaattaaatatgagtattactttcatgtacaaaatatttcctttatagtcttcatatgccctttaaaatgccaacaagatttcaagtctgtaggcctctagtgaggtggggtggcaaaccacagctaagtctcgctcaccactgcaagctaagaatggtttttacattttgggttggaaaaattttttttgaatatttcatgacacatgaaaattattcaaatgttagtgccgataaataaagtggtactgaaacacagccacacaaacttgtttttgtactgtctacagctactttcacactacagccgcagagctgagcagttcagcagaccgtatgtcccacaatgcctaaaacattgactatgtttacagaaaaagtttgctgacccctgctctagcaaacgcatcctttcctactccaccccaatttgtatttagatagtttctctaacagaacggacaaatgaggctgcaaactaatttatttttgtcaaaaatcaatgttttgacatccacagacagtgaaataaaagaaatggcttgctgaaaaacatgaggagtcctagccacaaaatcactgcttaggttgcaattgccaaaatgaagccttcttagaagcacttctttagtatatacaggtgttggctgaagtccgtgcctcactctgggaaccattcttagtctccagtgtctcctattacaaagaagctggcagaaataaaaatgaaggggtgagagcggttccaccctagtctcatggtggaaaattcattggggagagctgtccaggatatttggagtcctgggtagaaggagcttgtaactactttaaagtcgacatctttgcacaggtgattgagtttctctgacctcattgcttcacctctgtctcctcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttggtaaataaattctccataatgtagattaataatataaaagtctttaatgacacaatatatctatatagcctcactgtataattcagaaataaaaattgattctgc

SEQ ID NO: 24975 - DNA, 1530 bp, Homo sapiens
atgtgaccagaaaatggaggcgaatctgtatttccagttaactgctcagaagagagatgctgaagagctgtagtcgtgcatccttctcaccctccgttagaaagcctcctctcatcctcagaagattttaaattctctgagagcagaatgtgtctctgatccattctttttgtaatacagcctcccccgaggctaacactttccatatggctctaggactcaaatgtttgttgaactcctaccggaatgaatggcctgagaaacaaacaactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaaactggatgaagaactgagggaagcatcagaggcagctaaaactagctgcctttacaatgatccagaaatgtcttctatggagaaggatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaa

SEQ ID NO: 24976 - DNA, 1207 bp, Homo sapiens
ttccgccttcgcccacgtggtccggctccggctcagtcagccgcctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaagg

SEQ ID NO: 24977 - DNA, 2057 bp, Homo sapiens
gtgcagtcggtcgttccacttccgccttcgcccacgtggtccggctccggctcagtcagccgcgtcgcgaatggggcaggagcgagcctctctggtcccgacgcgggtggcccgggtctcctcgactcctgaggaaagcccaccgggcggggcgggaggtgaagaggctggggaagtcagaggttaacctgggcgtcaggggacgttggagttgatccgtcagggtcccggggcggtctgggggcagtagagacggggcttgggcgcggggcctgagaggtcaggggtcagcaggagtgaggctggggcgtccaggtccgagaggtcaggggtcagctggagaggggctggggcgccggtttcccggaggtcaggggtcagaaggaacagggctgcagcgtcagggtccgagaggttaggggtcggcagaggcggagctggggcactgggggtcaggggtcggggatcagggcggggtcgggtgcactggtagcctgcgcatgggcctccagcttcgcgcgctgttgggagccttcggacggtggaccctgcgcctgggaccgcgtccgtcctgctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaa

SEQ ID NO: 24978 - DNA, 1637 bp, Homo sapiens
cccacgtggtccggctccggctcagtcagccgcgtcgcgaatggggcaggagcgagcctctctggtcccgacgcgggtggcccgggtctcctcgactcctgaggaaagcccaccgggcggggcgggaggtgaagaggctggggaagtcagagctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaatc

SEQ ID NO: 24979 - DNA, 1664 bp, Homo sapiens
agttttgtccgcgctcggccgccgtgcagtcggtcgttccacttccgccttcgcccacgtggtccggctccggctcagtcagccgcgtcgcgaatggggcaggagcgagcctctctggtcccgacgcgggtggcccgggtctcctcgactcctgaggaaagcccaccgggcggggcgggagctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaa

SEQ ID NO: 24980 - DNA, 632 bp, Homo sapiens
ccgcgtcgcgaatggggcaggagcgagcctctctggtcccgacgcgggtggcccgggtctcctcgactcctgaggaaagcccaccgggcggggcgggagcttcgcgcgctgttgggagccttcggacggtggaccctgcgcctgggaccgcgtccgtcctgctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctggg

SEQ ID NO: 24981 - DNA, 1318 bp, Homo sapiens
aactacaacgtccggctttctgagttgggtggcgggaaaggcgatgagtaaaggccgggcagaagctgcggcgggagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggaccagtttgacatggtgagtgatgctgaccttcaagtcctagatggcaaaatcgtggccctcactgctaaggtgcagagcttgcagcagagctgccgctacatggaggctgagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagacccagcccatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaatttccaatatgt

SEQ ID NO: 24982 - DNA, 1354 bp, Homo sapiens
aactacaacgtccggctttctgagttgggtggcgggaaaggcgatgagtaaaggccgggcagaagctgcggcgggagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggaccagtttgacatggtgagtgatgctgaccttcaagtcctagatggcaaaatcgtggccctcactgctaaggtgcagagcttgcagcagagctgccgctacatggaggctgagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagacccagcccatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaatttccaatatgt

SEQ ID NO: 24983 - DNA, 1381 bp, Homo sapiens
cgggaaaggcgatgagtaaaggccgggcagaagctgcggcgggaggtaacggcgccgtgggcgcggggaagacccgggagggcagtgggtgaggaggtcggttgagtggccccctcccctgcctttctctccgtagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggaccagtttgacatggtgagtgatgctgaccttcaagtcctagatggcaaaatcgtggccctcactgctaaggtgcagagcttgcagcagagctgccgctacatggaggctgagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagacccagcccatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattg

SEQ ID NO: 24984 - DNA, 6926 bp, Homo sapiens
acgctagtggagcggaagatggcggcggcggcggcggccgctgcagccgggacttcagttgggctgaggcggaggagccgccgcttctgacctcgctctggctccggtgcgcgcggctgagcgcgtgcgaggccccgcgcgtcgggcaggggcggcggcggccactgcgcgccgccctgaggagcgccccagcggcggcgcgactgcggctgaggagagagccggctccgggcctccgcgtcctcctgctcccccggccccccgcctcctcgggggggcggcggcggcgatgttctcggtcctctcgtacgggcggctggtggcccgcgccgtgctcggcggcctctcgcagaccgaccccagggccggcggcggcggcggcggcgactacggactggtgacggccggctgcggcttcgggaaggacttccgtaagggcctcctcaagaagggcgcgtgctacggggacgacgcgtgcttcgtggcccggcaccgttccgcggacgtgctcggggttgcagatggtgtaggaggctggagagactatggagttgatccatctcaattctcagggactttaatgcggacgtgtgaacgtttagtaaaagaaggacggttcgtacctagtaatcccattggaattctcaccacaagctactgtgagttgctgcaaaataaagtccctttgctcggtagcagcaccgcctgcattgtggtgctggacagaaccagccaccgcttacacacagcaaacctgggcgattcaggcttcctggttgtcaggggtggtgaagtcgtgcaccgatcagatgagcagcagcattacttcaacactccattccagctctcaatcgctccccctgaagccgagggagtcgtcttgagcgacagtccggatgctgctgatagcacgtctttcgatgtccagctaggagacattatcctgacggcaacagatggactctttgacaacatgcctgattatatgattcttcaggagctaaaaaagttaaagaattcaaattatgagagtatacaacagactgccagaagcattgctgagcaagctcatgagctggcctatgacccaaattatatgtcaccttttgcacagtttgcatgtgacaatggattgaatgtgagaggtggaaagccagatgacatcaccgtccttctttcaatagtggctgagtatacagactagctgaggtgtcaagtcctgcctttcctttcatcatcccaaatttcccctgccatgtgtgctgatcctgctggcaggaccacatttctttgccactgatctcaatggccagtgatgtaagtcttttgcctgtcttcttgagactcgttgagatctttgttgagaaccactactatcattcactagctcatatctgccggcagcaattgaagagatccaatatttgaagattggccttcatttctcgatgttctttccatgatggggatggaggtgttcagtgccaccgtggctgttacttttcaaagtagttgaagtattgaaaatgagtaatgttggtaaagtgaattcaaaatcctagtatgctaaagggatggtacaagtctaacacaaattgtacgtaatgatacatctactagaaacatacattattcatcaaaagaaatgttacatgtgtactccacaggcatagtctttgttatgatgattggtgtggctttatgtctttgttataaactcctatttttcaggggcttatgattctgctctaaaacattgctctgggttatacagttttgatcccaaaagcttttttgttacaaatcgggagaaaaatccattttagttctatggatggaaatatttcatgcttttaaaaagatgtttgtgttcctgtggttaaagttttggcagtttattgattagtccaaatcacaggctaaggcctgatctccaggaggggtaggggagacactttaccagtatttttttatggaaataatactcaaggttgtaaaacccctcaaagcctagaaatttaattgttatggctgaaattcctcctagttgtctgatagaatgcccctgaatgggaactctaggtcccaaggcctgaagggttgagaacagacagctgtaactttgaattttgttggctttcagtggtcatgctacctacccatactcgtactctcagaccttttattagtagccttgctttctatagagcatgcaccaaatccagtgagtccatgtggagagagcactgtgtgcgcagcggcagcagcacagacgtccatgaggaaaactcccagtgatgatctgacatttacaattaccccacatggaaatttaggggtttctgaatcaagcttaatgtttacagtttccaaatagccattttgcagtgtatagtttccttacaaaactaccccgcattcagttttcacattatctgcaagctgaaacttatttttaagttttgtgtacaagttgactgctgtaaagatatatatttttgggtcagtttttttccttcattaacttggtggtagaaaaaaatatatacttagaaatccttaaattaaagccatgttttatatataagtcaggtaacattggtgtatagatgagaatgcaattaaacctgatgagaatctacttgagaatatagaaagtctttctctaaaggagatactgactccctggtttattgcattaaaatttatgtttgaggttacctcaacttgttttaaaagattttgttttgtgaatttgtactgtatatttgagtaactgtcaggcttttatttaaaattgtttaacatgtaccatgtacatgtcattactatatttcaatgcatcatgcttgtaacaggcatttcatttataataagaatgagttattcatttgtaagccgttcagtaatttatctactattcctaaattggcataatgttagataatctattttgaatcacctttaattacatgtcagaatgccttaactaccctaacttgacaaaacagaattctttggtagacgcggtgggggcggggtggggggtctggacggagtctctatttaaggagaaatcatcatgctatgataaaacacagaagcatgagtggcaagtggcggggtatttattttgcacaaactatttgcagtctctgtgtatttaaaaagtaaagaaagttgcatccagaagggttttgttagaatgaatacatttatattaggactgacaacttcagctcttttgtttaggttttcaattatttttggtaagagtatgtagccttatgatctggatatattttgcattcattttccaacgcctacatttaattcctggtaagagcagtgctcgtcaagtttctggtttttctctgctctcatttaacccgtcaaacacaatctttgtaaagctagattggtggtgttttatacaacttatttactcagcttacctttttgagaaacgattgttagaaattgacgatgtgtttgttccagtgatactgaaagtagtgggggcaagaattgagtttcacagtggaattggctttggatctggcctatagattagtgacataaaatattttctctattttcccctgttctttttgtgttatgcacttaattttatgactgccgggggggtcagctggagtgctgcttaacaagtatctctcctactctcagtggtcagaggctgtgttggacccatagtagaattttccaggtcacagacccaagcttccatgggttgttactgtgctgtaccacttggtgggtctgattctgaacctgatgtgtgtgttaattatattttaagcaacacacacacacacacacgcctcatgtaatggacttttataacaaaagaaaaaatttggatttctaatttacaaatggcaaattatttatccctctctggatgcaccaaagaccagtaaagtttatagcttttccatctatatttataaagcaatactgtattataaaaatcaatatttttatcacatgcttgaaatttttattttgttgttttaaaatgtgcactctaaacatatcagaaccttatttcttcctatgaacttaagctgcctgcgcacaaaaaaaaaaaaaatttaccaaatggagatgcagtagagtccataggctctaaaaactaaaagaaatgggatgcagggggaacaagttatttgtcctgagttactgtacttgcttgacatggttgttgggtactaaatcacaaaagaatccattccaggtatgcatgtctgggggttgggctgtgtctagattagaaactgggtttcaagctttgcatgatgggagagcgtcctctcctctatcagctgcgtgtgttctggataggacagtagcccggagatggaaaccaccttcagtaccattagcccaccataccaagtaacaagttaggcaggaatcgtgggaatttattgagtcagctttgagtgtttgagagaatgtaaacaagattggctcgaattgtaaacgtttgtactttggatgagttcatggttctttaggtcaccttaataccagctatctttggtagaagctacagcattcagtttctctggaaactgtatcacatttttgcattttaaaaattttacagtatcaaaaaaccaaaatctgcttatgaaacaaaacatgaagcaggacatatttggattctatttatttaaaattaaattctttgcaaaattgaacttctcaactaaaacgtgtccatgtcagaattttaactgttagcaggtagtttgtggcaaagatggctaaataatgaagcaaattagaatctgtgtgtatactaatgagctgctttttttctgttgagactatcattatttgtcttattacccaagaggcaattacctgaatttggatgtctgaattataacttatgcaggaatagttctgtaaatacatttaaataaactgtaaagatatttaataaatatagtatttatactaatctgtgtgcttcttttggtttgaatagtaactaaatgagacaccagcccttgacattgagtttgttggtcactatcaggtcctcatttccaagcctcctagtcattctagcactgattatatgctgctactttaactggctccagctgcttcactacatcagtttagcttcctcagaaattcatcaaaatggacggacaattaaatgtaaattatagaactttttcccagctgaggctttgcaccttccgtatagtatagagggaagctacaaaaaaaatctgctgtacagtcagtcgtgttgtttaacagagatgttctgacagatgcatccttagcaatttcatcattgtgtactgacacaagcctagatggtctagcctactacacatctgggctatatgaatagcctgttgctcctaggcgacaaacctgtataacatgttactgtactgaatactgtaggcagttgtaacacaacagtaagcatctgtatatctaaacatagaaatgtttcagcaaaactatggtatgaaagacaaaaaaatggtacacctgtatagggcagctccattatcttatgggaccaccactgtctgtgcagtccatcgttgaccaaaacgttgttatgcagcacatgactgtatttcagcttagcactctgtatccaaattctaaaatccaaagtgcccagctaatttttgtagagatgggatctcaccatgttgcccaggctagtcttgaactgctgggctcaactgatccgcccacctgggcctcccaaagtgctgggattacaggcatgagccactacaccccgccagtattaactataataatagtccaatgctgcatccaggctattactgatgatgatgcctttaagacctaaacccctctgcctacttcaatgaatgaaccagaaatgttatcctcagcaaagagacctacagagttacttttgtgtataaaagctccctgtgtaggcatctgcatttgttagaaataccagaaattcagtgttaatcatcagtgtaagcataagatacatatatcttcccctaccatgtgatgaaaggacttagttgaaattatgtgggcattgccagttaccacaaaaagcttggttaaggcccattttcattcactaaggaacatcttgggatgaacttgagtttttattaggttattgtgggtagctatgactcattactaagctacaagagccaaattaattctggtttcagttagaactctattcacagttctaaagcatgcaaatccactcagccacctttatgaatttctcacaaagtctaaagtacaactgcttgccagttaacacttccttacggtttgaaggtttcagaaagatgtaacaataatatgttacaaaagtctcgtttgtcaggttataattgactgtaaacaggtttgggggagggagaggcacacatcataagacattacataacaatgttttgtgccagattttttagtccatttgtgcaggtaaaaagctaactcttaaagggccaaagaacagagacatttgtcttccaccttattccactccaaactcaggctgtcttggcagtggaggatactgttctatgtcagataatacagaaatatttggcatcacttccattaaattctttcctgcagcacactgcaaaataaaaaatcacatctgaaaatcagaacaatttgaggttaggaaataaaattttacaatatgtaaaaacactccaggttgggcgcagtggctcaagtctgtaatcccagcactttgggaggccgaggtgggcagatcacttgaggccaggagttcaagaccaccctggccaacatggcgaaaccctgtctctacaaaataccagaaattagccaggcatggtggcacgcacctgcaatcccagctgcacggg

SEQ ID NO: 24985 - DNA, 2660 bp, Homo sapiens
cgcagaggcaccgccccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacatggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctctgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttcaactga

SEQ ID NO: 24986 - DNA, 1223 bp, Homo sapiens
agagtccacctggcggccaagggcgctggcgaccgctgaagctcctgggggtgttcggggtccgggctgcgcctgtgcccgcgggaaggctgggcgcttcccacacacagaccccgctccgggccagccccgcagggagactaccagggctggcggtagctgggcgtggtcgggtcgggggcggctgtgggcggccggcaggcagcgcgcggggcagccctcggcagacggccaatggcggcggtgctcggggcgctcggggcgacgcggcgcttgttggcggcgctgcgaggccagagcctagggctagcggccatgtcatcaggtactcacaggttgactgcagaggagaggaaccaagctatacttgaccttaaagcagcaggatggtcggaattaagtgagagagatgccatctacaaagaattctccttccacaattttaatcaggcatttggctttatgtcccgagttgccctacaagcagagaagatgaatcatcacccagaatggttcaatgtatacaacaaggtccagataactctcacctcacatgactgtggtgaactgaccaaaaaagatgtgaagctggccaagtttattgaaaaagcagctgcttctgtgtgatttcttccaaaatacatgtaaaatcttgtacacatcttagctgcaatgtatgttgaaggaaatttatgtgaacaaatagagttgttctttttctcttttttttaagacagagtgttgctctgtcgcccaggccagagtgcagtggtatgatctcggctcactgtaacctccgcctcccaggttcaggtgattctcctgcctcagcctcctgagtagctgggattacaagcacgtgtcaccacgcctggctaatttttgtatttttagtatagacagggttttaccacgttggtcaggctggtctcgaactcctgacctcgtgatccgcctgcctcagcctcccaaagtgctgggattacaggcatgagccaccatgcctggctgttgaattgttcttaaggcatcatatctagaagcaaagaaaaaagaaaaataacaatttaagttgtgtaaattgtttgcctttatatattacatttggtaaaatcagtgcttaaatacgcaatgatttaaactggaacctgaggtatttttcatgctatctaatcatatacctaagataaaccaacccagttacttatattaataatattcag

SEQ ID NO: 24987 - DNA, 5621 bp, Homo sapiens
cagccctcggcagacggccaatggcggcggtgctcggggcgctcggggcgacgcggcgcttgttggcggcgctgcgaggccagagcctagggctagcggccatgtcatcaggtactcacaggttgactgcagaggagaggaaccaagctatacttgaccttaaagcagcaggatggtcggaattaagtgagagagatgccatctacaaagaattctccttccacaattttaatcaggcatttggctttatgtcccgagttgccctacaagcagagaagatgaatcatcacccagaatggttcaatgtatacaacaaggtccagataactctcacctcacatgactgtggtgaactgaccaaaaaagatgtgaagctggccaagtttattgaaaaagcagctgcttctgtgtgatttcttccaaaatacataagtctgagaggctaaacttgatggctgtgttaacatatgtcacgtgtagcacagtggagaaagcaggatatggctcataatgacagtggtgaagacctgcgaatgaagttgctagttatcacctacattagggtttgacataggtctatgttatgggtcgctgcatctgctggaactcacagactttactatagagaatcaaagatcccgtatccgaagtctatggaaatgctcatggtggtaaattccaacagaatgaaacaccaaacttgcttaaagtaactcacgtttcaatttgaaagagatattgtcaaaattggaggcccccaggttcctgtctgttccaaatctttgcatgatgacagtggtttctctgatgtggtaagctttggctttcttctgttttctttctaaaagatcactggagtagagaggagttaaacagacatgacctttgacctcttgcatgacctccacagatagcaaaccgggccgacacatggttgacgatgtccttttctacaatgaagttaatgaaagttctgaaaatagtgattactttctgacattgataggatttaggaaacctctggataaatagcttaagcatggctgtttatgtttttgctatagacaaaaagcagcagcatgtacattgtatttggacacaagcctgcctcggttaatatattgaactattggaccactagggttagtagggagcggtctgtacactttctgattcagcattcagaaacattctaggtggactctgtagctttcagttttgtaaagttatcagaaaaacatcgggagggtttggccatcatatgtgagctttgtgtttcaatgccagttactcaggattagtaaattaatgactgtccagaggacttcagggtcaccaagctgctgcacctgccattggctgactctccccggctatctgtggctgagatggtgctgcttaggtcacgcagagcatgagctgctgctgaaagggcacaggagatggcccttgggcttctcatcccaggatgcctgccctgcccaccaatccatgagaagatatgtatgatttcagtaggccctggatcagcttgtcacctctggtttcctgtttgctttccactcactcagctggagtttcatttccagactaaagtcttcatcattggcttcagaaacagcattcatctgtggctgtgctgatgtagtacaccaagaacaactgggctcttctctgtcactttcagtgggctaccttccctcacctctccaagcagcatgaaagaattctttacatttttaatctcttttttgtttttccctgaaagtatgctttggtgcttaaagagagaagtcacaaaagtatactactgagtttcctggagatgaaatcctgttgtccctagctatgtgaatgagcacagggatccctgatgccattattttgtatattcatacggcacacacttactgagggccttctgtgtgccctaggggattgagcacagtgacatatcagggcaggtagaaacagatggagagctgatgcgggctgtcttagagcagctgccccaggaggcccctgtggatggatgttgggcaggagccctgagacgttaggggcatataactaaaggacatagcaggagttataggaggagctgatccctgagggaaacaatgaagacggagaagatggggctaaagtttgaattgtggggacattaatcacagtgattcttaaaactttgctgttgatgattttaaatggagaaaatgagtacgtaagatgttatttcccagttcagtatattggttgcccacaaagtattttcctaccatgaatggtcatatatacttgttgtagaataccagggacagcagagatggtggggtagttacttccttttcttacagcccaagaactttggtgtccaggagattgaccaatttagccactgagcatttaatacaacacagggctacccagatcccactgtcctgatttgccctgaaagccaaaggagttaggagaaggtgagtggggagaatatattaatcctgagagttgaacagagcaaaaatccctattacttttgtacttaaaacatctctgccacatgtgctcactctttatattctgtttaggtggtttatatgtgcacatcccatcctatgcctgcagttagccaactcagggtttatattgcctcctttctttttttctttttttttttttttttaagagatggggtctcattctatcatgcagactggagtgcagtggtgtgatcacagctcattgtaacctccaacgcctggactaaagtgatcctcctaccttggcctctctggtagctgggactacaggtgcatgccaccacacccacctaattttttttatttttattttttgtagagacagtctcactatcttgctcaggctagtcctgaactcctgggctcaagttatcttgctgcctcagcctcccatgggtaatttttatttcctttttttttttttttggagatggagtttcgctcttgtcgcccaggctggagtgcaatggcacgatcttggctcactgcagtctccacctcctgggttcaagtgattctccatcctcagcctcctgagtagctgagattacaggcaactgccaccatgcgcggctaatttatgtatttttttttagtaagagatggggtttcaccatgttggccagactagtcttaaactcctgacctcaagcgacctgcctgccttggcctcccaaagtgctgggattacaggcatgagccgctatgcctcgtcgctgatttttatttcttattttttttttagagatgggggtctcactatgttgctcaggctgatctcaaactcctggcctcaagtgatcctcccaccttagcctcccaagttgctgggattataagtgtgagccactatccctacctcactattaccttctttgcttctcttgttttcttttgttctaagtcaaacccatcacaatcttttcttgtccttccaggtgttttccagtgctgtgccctggatgtgctctctttctcttagagcccagagaacttgcttttcccccttatatatgacccttaactttttctaacacattattaagggcctgtgtctatcagctgggggcacttcttgaagggagggcctttgtgtggtctgtttctagtgacttccagctttaacccagagcctcatgattgctgggtgcccatagcctttttgctgaatggaggcactcagtctccttgggaagagagaatccatgatagacccacttgggagctccccacttcaggggcctacacactggtaatgcaacagaatgcccaagagtgacctcataaagcaaggattcccttcgtggccccttctctgctgcctctcagaatccagacgctaaggaaaatccctaagcagagattttctgttggatgctaaaagcaaggaataaaagttgaaaatttggaaaatgtctcaacaccgtcaccagcgccactcgagagtcatttctagttcaccagttgacactacatcggtgggattttgcccaacattcaagaaatttaagtaaatattatctatctccattgcctgttaagaaatgtgctagtagaagtgtgagggcagggtgtcagtgttctctcagcctcttccctcagatactcgtctgcttaccaaaataagttgcatgtccttgacaatctggtttctatgattggtgaggctggcatgctattacctttatgtgccctgtagacttgaatgaccagtttgaccagtttgactgttagataatctgaaggcttttctctttttttataatagaccccatctcaaatcagataatgaaaattacatatcttgatatattagaaaagtatatacattctggctgggcacggtggctcacacctgtaatccctgcactttgagaggctggggcggatcacttgaggtcaggagtttgagaccagcctggccaacgtggcgaaaccccatctctactaaaaatacacagattagcccggagtgatggtgtgcacctgttgtcccagctactcaggatgctgaggcaggagaatccctttaacctggggggcgaaggttgcagtgagccaagattgcaccactgcactccagcctgggtgacagaacgagactctgtctcagaaaaaaaaaaaaagaaaaggaaaaagaaaaatatatattctatatttttttaacttatgagaatgtgttcatttcatttgtaacatataatgggaaacagtaatacgtactctgagaaaaattgcaaagcacagataaatggaaataaacaggaaaaagaatcacctataacctcaccatccatagacagacactgttaaaattttggcatatttcctgctgattttttctactgctgatttttgcacaggtgagataattttgaacagagaattttgtatctttggtttttgtgttttgctgcacacaaaaacaaaagatataaaaatggatcataaacatttttctaaatcctgaaaaatgcatagacatattttagtgcctgtatttcacaagatggacataccataatttacttacacagtcctttttgttagatgtttaagttgttttcaagcttctcagtgctggaaaaaatactgagatagacatgtttagttgaagttatttcatttcaggttatattatcttgggtcagagaatgaatggttctcaggcttttcaaaagagctggtcagtttttatgcctctggcagtttttgagagtgctcaatcatactacactgttgccagcattagatcttatcacatttaagtcattgctaattttataaacaaaaacaatggttttactttgcatctccctgattggtattgctgtagaacatatttggagaagtttgtttgtctttggtgtttatttcatgaatagattgtgtgcccattttctcttggggtattcagttttttattactgatgtgagcatgtgtatgggtgattatttgatgattatcagttttgcttagtagactggcaatatttagtcttgctgtcactgtgttcccagtgcctactagattgcttgatatgtagttgccactcaataaagatttgttgagtcaatgaa

SEQ ID NO: 24988 - DNA, 4272 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctg

SEQ ID NO: 24989 - DNA, 3199 bp, Homo sapiens
gcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctg

SEQ ID NO: 24990 - DNA, 4071 bp, Homo sapiens
cgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagcctttttta

SEQ ID NO: 24991 - DNA, 3801 bp, Homo sapiens
cgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccaatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagcctttttta

SEQ ID NO: 24992 - DNA, 4023 bp, Homo sapiens
cgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaagacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagcctttttta

SEQ ID NO: 24993 - DNA, 1736 bp, Homo sapiens
gctcgagaactgccgagagttgctggctctcgggcccagatggggagtttcttgtcgggggagaaaagaccatccgcacccaccgtggggagcgcgatggagaaaaaggaattccccaccccacccggcagggtcggcccaggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcag

SEQ ID NO: 24994 - DNA, 807 bp, Homo sapiens
ttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccagtgagcacctttgccctgaaggtcaaggagaggtggaggggaacacaggtctgggtgtgatggacagaggcttccctgctgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatc

SEQ ID NO: 24995 - DNA, 1238 bp, Homo sapiens
aagaagaggagcacaccacaccagaaacagacatcttgcagtgtttcactgtctcaaccttatctgcacagtccgaggtcagtctgagagagcttctgagagacccaggatgaagggatgcagtgaggtcaagagcccaaccttctttcactgacacccacctctaaggactcagagagacatgaataaaatgggcctcaacaatcccaagagaccactcaaggacaatgggagccactgggcttggctttctactttcctggagacaagacaatttgaatggcactgactgccagggatgcaatattttatacttctctgagactacggggagcatgtgttctgaactttccttgaacagaggtcttgaggccagaaggaagaaggatcttaaagactcatttctctggagatatgggaaggttggctgtatctcacttccacttcgtgagatgaccgcctggattaacccaccccaaatttcagagattttccaaggctaccaccagagggtgcacggagctgatgcactgagcctgcaaaccaactctctgagaagcaggttatcttcacagtgcctcggacagagcttccttctcaggacactcgagagaggccgtggtttcagggcacttggggacatctgtggccacgttcatgaagaagactaagcctacttcatctcaggacccgcccaagagtggccgcggctttgggacacctggggtcgggtccaccatgaggataaaacctccttctcttctggacatgtccaggagtggccgttgctacaagtcacctggtgctacgaccagggtgagaataaagacgtctcctcaggaccctcccaggagagtacatggcattgagacatctggcggccaagtgaggaaaagacaccctgtctgcagcacccagaactgaggaggggcactgccctgggccttacttcccagccctggcctccaattctgaccttacaaaagtgtcccttgagtgaggcagtgaccacgcattgtcacagctaccaaagtgtggtttgcagatgatctgggcttgtttctggcagagattctggtacagagaaaggagaggcgctgagtggaaccacgatgggctgaggccaggggagacatcacaacctccaacaacactttttttcatgctttaataactcatttttcttagagaactaaagtagttgaaacaatatagaaacattttttaagtaggcatat

SEQ ID NO: 24996 - DNA, 443 bp, Homo sapiens
aagaagaggagcacaccacaccagaaacagacatcttgcagtgtttcactgtctcaaccttatctgcacagtccgaggtcagtctgagagagcttctgagagacccaggatgaagggatgcagtgaggtcaagagcccaaccttctttcactgacacccacctctaaggactcagagagacatgaataaaatgggcctcaacaatcccaagagaccactcaaggacaatgggagccactgggcttggctttctactttcctggagacaagacaatttgaatggcactgactgccagggatgcaatattttatacttctctgagactacggggagcatgtgttctgaactttccttgaacagaggtcttgaggccagaaggaagaaggatcttaaagactcatttctctggagagacggggtttcaccgtgtttaccatgctga

SEQ ID NO: 24997 - DNA, 1238 bp, Homo sapiens
aagaagaggagcacaccacaccagaaacagacatcttgcagtgtttcactgtctcaaccttatctgcacagtccgaggtcagtctgagagagcttctgagagacccaggatgaagggatgcagtgaggtcaagagcccaaccttctttcactgacacccacctctaaggactcagagagacatgaataaaatgggcctcaacaatcccaagagaccactcaaggacaatgggagccactgggcttggctttctactttcctggagacaagacaatttgaatggcactgactgccagggatgcaatattttatacttctctgagactacggggagcatgtgttctgaactttccttgaacagaggtcttgaggccagaaggaagaaggatcttaaagactcatttctctggagatatgggaaggttggctgtatctcacttccacttcgtgagatgaccgcctggattaacccaccccaaatttcagagattttccaaggctaccaccagagggtgcacggagctgatgcactgagcctgcaaaccaactctctgagaagcaggttatcttcacagtgcctcggacagagcttccttctcaggacactcgagagaggccgtggtttcagggcacttggggacatctgtggccacgttcatgaagaagactaagcctacttcatctcaggacccgcccaagagtggccgcggctttgggacacctggggtcgggtccaccatgaggataaaacctccttctcttctggacatgtccaggagtggccgttgctacaagtcacctggtgctacgaccagggtgagaataaagacgtctcctcaggaccctcccaggagagtacatggcattgagacatctggcggccaagtgaggaaaagacaccctgtctgcagcacccagaactgaggaggggcactgccctgggccttacttcccagccctggcctccaattctgaccttacaaaagtgtcccttgagtgaggcagtgaccacgcattgtcacagctaccaaagtgtggtttgcagatgatctgggcttgtttctggcagagattctggtacagagaaaggagaggcgctgagtggaaccacgatgggctgaggccaggggagacatcgcaacctccaacaacactttttttcatgctttaataactcatttttcttagagaactaaagtagttgaaacaatatagaaacattttttaagtaggcatat

SEQ ID NO: 24998 - DNA, 443 bp, Homo sapiens; identical to SEQ ID NO: 24996

SEQ ID NO: 24999 - DNA, 5360 bp, Homo sapiens
ggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctg

SEQ ID NO: 25000 - DNA, 4486 bp, Homo sapiens
atgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctacaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcaggtaattaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctg

SEQ ID NO: 25001 - DNA, 3572 bp, Homo sapiens
gaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcaggtaattaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggttt

SEQ ID NO: 25002 - DNA, 4043 bp, Homo sapiens
gtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcaggtaattaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaa

SEQ ID NO: 25003 - DNA, 3936 bp, Homo sapiens
gggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcgcaggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcaggtaattaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagcttt

SEQ ID NO: 25004 - DNA, 549 bp, Homo sapiens
cactctgtcgcccaagcgggtgtgcagcctcccgctcctgggctcaaatgatcctcccacctcagcctccctagtagctgggactataggcacatgccaccatgcctggctaattatttttagtagagataggtcttgctatgttgcccaggctggtcttgaactcctgggctcaagctgtctgcccacctcagcctcccaaagtgctgggattgtaggtatgagccaccacacccaactgaggcttctggtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggagga

SEQ ID NO: 25005 - DNA, 1661 bp, Homo sapiens
agtgggccgccatgttgtcggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcagacggaattttgcttttgttgcccaggctggagtgcaatggtg

SEQ ID NO: 25006 - DNA, 5880 bp, Homo sapiens
aacaggtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcaggtaattagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaatacccctctgtacctc

SEQ ID NO: 25007 - DNA, 6112 bp, Homo sapiens
aacaggtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaatacccctctgtacctca

SEQ ID NO: 25008 - DNA, 6117 bp, Homo sapiens
aacaggtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcaggtaattagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaatacccctctgtacctc

SEQ ID NO: 25009 - DNA, 3594 bp, Homo sapiens
attgccgccaccgaaggcggaggagggggaggaccgccaagagcgacgccgccgtgtgcccaacggtcggtgtccccggctgaggcagcgcggccgcagcagccctgtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatc

SEQ ID NO: 25010 - DNA, 546 bp, Homo sapiens
attgccgccaccgaaggcggaggagggggaggaccgccaagagcgacgccgccgtgtgcccaacggtcggtgtccccggctgaggcagcgcggccgcagcagccctgaaacagtcataacctcaaaaatgactttttaattcaaatataagattatactgggtcttggccaaagaaaagtttctgtcgtatatttctgtgttggtgctttcgtgctacagaggcgtagttgagtagctgcagcagagatcatatggcctgcaaagcctaaaatgttgactcctacactaggggtatgatttatcccaacagtaagaatggattcaaagagctaagagacctctcaaaattatccagaggttctttaacttatgtgacctcatctatttggaccactgataaaaacctgaaagtaagcaaaaaaggtttgatctgtggatgaaatgaatcatgattttcaagctcttgcattagaatctcggggaatgggagagcttttgcctaccaaaaagttttgggaacctgatgattcaacaaaagatggaca

SEQ ID NO: 25011 - DNA, 955 bp, Homo sapiens
gaggcagaggaagactgtctccagaattacttgggaagtaaaaatctgcgaggcttggtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacata

SEQ ID NO: 25012 - DNA, 3404 bp, Homo sapiens
gaggcagcgcggccgcagcagccctgtttgatctgtggatgaaatgaatcatgattttcaagctcttgcattagaatctcggggaatgggagagaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatc

SEQ ID NO: 25013 - DNA, 1509 bp, Homo sapiens
ataagccagagcctagaccagtgagccaactgtgcgaaccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttca

SEQ ID NO: 25014 - DNA, 557 bp, Homo sapiens
cgacccagcttcccttgtccagggagcaactcagacacagtctcgcttcatttttattctggggttgtacaatctaagggccggcccgcgtgctcgcttgccattggctggggactccagggcaagggatataagccagagcctagaccagtgagccaactgtgcgaaccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctg

SEQ ID NO: 25015 - DNA, 2858 bp, Homo sapiens
acttgaggagtcgactgagagctttatctttgcccctgtgacgggtggcctgtggtttcctgccaacaactcctgtttccggaggcccaacaaggcccacgcagagccaggaggggcagtggggctgggcctgggtggccccaccagccccgccccatctatctttgggaatttatttgtccatgggcgaggctggcctgcagtctgttgccttccaggggccaagagctgctctgatcacccagggattctctctccaacccaagtgcctccagctgacctctggctcctgtcctctggctccacctgcaccgccctgctcttcctaaggggccaggaagcccccagaagctctaccatcgacgtgggtggtggcacccggctcaccctgagagcagaggccgtgcagggggctcagttctgagccccagccggcccaccatggcacggcggttccaggaggagctggccgccttcctcttcgagtatgacaccccccgcatggtgctggtgcgtaataagaaggtgggcgttatcttccgactgatccagctggtggtcctggtctacgtcatcgggtgggtgtttctctatgagaagggctaccagacctcgagcggcctcatcagcagtgtctctgtgaaactcaagggcctggccgtgacccagctccctggcctcggcccccaggtctgggatgtggctgactacgtcttcccagcccagggggacaactccttcgtggtcatgaccaatttcatcgtgaccccgaagcagactcaaggctactgcgcagagcacccagaagggggcatatgcaaggaagacagtggctgtacccctgggaaggccaagaggaaggcccaaggcatccgcacgggcaagtgtgtggccttcaacgacactgtgaagacgtgtgagatctttggctggtgccccgtggaggtggatgacgacatcccgcgccctgcccttctccgagaggccgagaacttcactcttttcatcaagaacagcatcagctttccacgcttcaaggtcaacaggcgcaacctggtggaggaggtgaatgctgcccacatgaagacctgcctctttcacaagaccctgcaccccctgtgcccagtcttccagcttggctacgtggtgcaagagtcaggccagaacttcagcaccctggctgagaagggtggagtggttggcatcaccatcgactggcactgtgacctggactggcacgtacggcactgcagacccatctatgagttccatgggctgtacgaagagaaaaatctctccccaggcttcaacttcaggtttgccaggcactttgtggagaacgggaccaactaccgtcacctcttcaaggtgtttgggattcgctttgacatcctggtggacggcaaggccgggaagtttgacatcatccctacaatgaccaccatcggctctggaattggcatctttggggtggccacagttctctgtgacctgctgctgcttcacatcctgcctaagaggcactactacaagcagaagaagttcaaatacgctgaggacatggggccaggggcggctgagcgtgacctcgcagctaccagctccaccctgggcctgcaggagaacatgaggacatcctgatgctcgggccccaactcctgactgggtgcagcgtgaggcttcagcctggagccctggtgggtcccagccagggcagaggggcctccccaggaagtctcctaccctctcagccaggcagagagcagtttgccagaagctcagggtgcatagtaggagagacctgtgcaaatctgagctccggctccgaccccacacaccctgagggagccctaccctagcctcagccgctcctggtggggaatggctggggctgggcaggaccctcccacacacctgcaccctagcttcgtgcttctctctccggactctcattatccaacccgctgcctccatttctctagatctgtgctctccgatgtggcagtcagtaaccataggtgactaaattaaactaaaataaaatagaatgaaacacaaaattcaattcctcggctgaactagccacatttcaactgctcagtagatacgtgtggttagtggctgccatactggacagctcggggcattttcactgtcaaagaaagttctattagacagccctgcttgagccctgtttcttcctggccttcggtttccctggggaacttatcgacaatgcaagctcctgggcccacccccagacctcctgaaccaaaagctccagggctggccgtatgatctgtgtggatggcaaactccccaggccattctgggacctaagtttaagaagtgccgtcctcgaactttctgactctaagctcctgagcgggagtcagacttagccctgagcctgcacttcctgttcaggtgcagacactgaacagggtctcaaacaccttcagcatgtgtgttgtgtgctcacgtgccacacagtgtctcatgcacacaacccagtgtacacaccacctacgtgcacacagcatccttccacactgtgtatgtgaacagcttgggccctgcaaacacaaccatctacacacatctacacccccaagcacacacacatggtccgtgccatgtcacctccatagggaaaggcttctctccaagtgtgccaggccaggacagccctcccagccatgaatccttactcagctacctcgggttggggtgggagccccagccaaatcctgggctccctgcctgtggctcagccccagctcccaaggcctgcctggctctgtctgaacagaaggtctgggggaagcgacgggtggagtacaataaagggaatgagg

SEQ ID NO: 25016 - DNA, 1831 bp, Homo sapiens
ccccttctgagtgtcccctgagcactctctcagcatgaactgcatatccgacttcttcacctatgagaccaccaagtcggtggttgtgaagagctggaccatcgggatcatcaaccgagtagttcagcttctgatcatctcctactttgtagggtgggttttcttgcacgagaaggcttaccaggtacgggacacagccattgagtcctcggtggtaaccaaggtgaagggctccggactctacgccaacagagtcatggatgtgtctgattacgtgacgccacctcagggcacctcggtctttgtcatcatcaccaagatgattgttactgaaaatcagatgcaaggattctgcccagagagtgaggagaaataccgctgtgtatcagacagccagtgcgggcctgagcgcttgccaggtggggggatcctcactggccgctgcgtgaactacagctctgtgctccggacctgtgagatccagggctggtgccccacggaggtggacacagtggaaacgcccatcatgatggaagctgagaacttcactattttcatcaagaacagcatccgtttccccctcttcaactttgagaagggaaacctccttcccaacctgacagccagggacatgaagacctgccgcttccacccggacaaggaccctttctgccccatcttgcgggtaggggacgtggtcaagtttgcggggcaggattttgccaaactggcgcgcacggggggagttctgggcattaagatcggctgggtgtgcgacttggacaaggcctgggaccagtgcatccccaaatactccttcacccggctcgacagcgtttctgagaaaagcagcgtgtccccaggctacaacttcaggtttgccaagtactacaaaatggaaaatggcagtgagtaccgcaccctcctgaaggcttttggcatccgcttcgacgtgctggtatacgggaatgctggcaagttcaacatcatccccaccatcatcagctctgtggcggcctttacttctgtgggagtgggaactgttctctgtgacatcatcctgctcaacttcctcaagggggccgaccagtacaaagccaagaagtttgaggaggtgaatgagactacgctgaaaatcgcggctttgaccaacccagtgtaccccagcgaccagaccacagcggagaagcagtccaccgattcgggggccttctccataggccactagggcctctttccagggccccacactcacaaaggctccaggcctccccacagaggaccctgcctgagcaaggggcatgggagggaagaggggctctcatttctgctgctcattccatgagcatagctgggacccaagtgtctgggcctccgactgctccagcagacaggcagtgctccctgctgagaccccaatctcaccttcactccttgcctggccccatctgcttcctaggacccctggggcaggagcacctgagccatccccttcccaaagagtagagattataatgtaggacagatggccacaagggcctaccaagtgccaggcactttcacacacgttatctcatttaatccttagaataatcctatgaggtagatattagtttcccttgttttgaagataaaccaaggctcagagagactgagtcatttgccccaggccagatagccaggatgtgagagagctgggatttgaacgtccgtctgactaactccatcgcccacaccccatgagagaagaatgaactcccagggtccatcagccctgctgcttcagccgcctccaccctgacggtgattcggttaataaagagtaagcccc

SEQ ID NO: 25017 - DNA, 1346 bp, Homo sapiens
cctgtcctgtaggacctccctctcctgaggccaccactgggcccccttctgagtgtcccctgagcactctctcagcatgaactgcatatccgacttcttcacctatgagaccaccaagtcggtggttgtgaagagctggaccatcgggatcatcaaccgagtagttcagcttctgatcatctcctactttgtagggtgggttttcttgcacgagaaggcttaccaggtacgggacacagccattgagtcctcggtggtaaccaaggtgaagggctccggactctacgccaacagagtcatggatgtgtctgattacgtgacgccacctcagggcacctcggtctttgtcatcatcaccaagatgattgttactgaaaatcagatgcaaggattctgcccagagagtgaggagaaataccgctgtgtatcagacagccagtgcgggcctgagcgcttgccaggtggggggatcctcactggccgctgcgtgaactacagctctgtgctccggacctgtgagatccagggctggtgccccacggaggtggacacagtggaaacgcccatcatgatggaagctgagaacttcactattttcatcaagaacagcatccgtttccccctcttcaactttgagaagggaaacctccttcccaacctgacagccagggacatgaagacctgccgcttccacccggacaaggaccctttctgccccatcttgcgggtaggggacgtggtcaagtttgcggggcaggattttgccaaactggcgcgcacggggggagttctgggcattaagatcggctgggtgtgcgacttggacaaggcctgggaccagtgcatccccaaatactccttcacccggctcgacagcgtttctgagaaaagcagcgtgtccccaggctacaacttcaggtttgccaagtactacaaaatggaaaatggcagtgagtaccgcaccctcctgaaggcttttggcatccgcttcgacgtgctgtatacgggagctggcaagttcaacatcatccccaccatcatcagctctgtggcggcctttacttctgtgggagtgggaactgttctctgtgacatcatcctgctcaacttcctcaagggggccgaccagtacaaagccaagaagtttgaggaggtgaatgagactacgctgaaaatcgcggctttgaccaacccagtgtaccccagcgaccagaccacagcggagaagcagtccaccgattcgggggccttctccataggccactagggcctctttccagggccccacactcacaaaggctccaggcctccccacagaggaccctgcctgagcaaggggcatggga

SEQ ID NO: 25018 - DNA, 2032 bp, Homo sapiens
ccgcaagtgctgggatgacaggtgtgagccaccgcccccggcccctcgcccgccttttgaaggagcctttcgtcctcaagggcgaggccactccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaa

SEQ ID NO: 25019 - DNA, 1836 bp, Homo sapiens
gcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgctaccatccccatttggcagaagtggaaatggagtcccctagaaggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggt

SEQ ID NO: 25020 - DNA, 986 bp, Homo sapiens
agaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacgacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggtg

SEQ ID NO: 25021 - DNA, 1084 bp, Homo sapiens
atggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcagacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagt

SEQ ID NO: 25022 - DNA, 1612 bp, Homo sapiens
agaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaa

SEQ ID NO: 25023 - DNA, 2983 bp, Homo sapiens
gagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccgtcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccaacctgcccagctgctgccgctggaggatccggaaagagtttccgaagagtgaagggcagtacagtggcttcaagagtccttactgaagccaggcaccgtggctcacgtctgtaatcccagcgctttgggaggccgaggcaggcagatcacctgaggtcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtcccccaaaaaaaaaaaagagtccttaccaatagcaggggctgcagtagccatgttaacatgacatttaccagcaacttgaacttcacctgcaaagctctgtggccacattttcagccaaagggaaatatgctttcatcttctgttgctctctgtgtctgagagcaaagtgacctggttaaacaaaccagaatccctctacatggactcagagaaaagagattgagatgtaagtctcaactctgtccccaggaagttgtgtgaccctaggcctctcacctctgtgcctctgtctccttgttgcccaactactatctcagagatattgtgaggacaaattgagacagtgcacatgaactgtcttttaatgtgtaaagatctacatgaatgcaaaacatttcattatgaggtcagactaggataatgtccaactaaaaacaaacccttttcatcctggctggagaatgtggagaactaaaggtggccacaaattctttgacactcaagtcccccaagacctaagggttttatctcctccccttgaatatgggtggctctgattgctttatccaaaagtggaagtgacattgtgtcagtttcagatcctgatcttaagaggctgacagcttctacttgctgtcccttggaactcttgctatcggggaagccagacgccatttaaaagtctgcctatcctggccaggtgtggtggctcacacctgtaatcccagcactttgggagaccaaggcgggcggatcacttaaagtcaggagtccaagaccagactcgccaacatggtgaaaccgtatctctaataaaaatacaaaaattagctgggcatggtgcgggcacctgtagtcctagctatcaagaggctgagacaggagaaacacttgaacctgggaggtggaggttgcattgagctgagatcgtgccactgcactccaggctgggtgacagagcgagactccatctc

SEQ ID NO: 25024 - DNA, 924 bp, Homo sapiens
gtttcattttgcagttactgggagggggcttgctgtggccctgtcaggaagagtagagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggtaagagattctcttttccatgctttaggaaaatggtttggagaaggaagtgactaa

SEQ ID NO: 25025 - DNA, 1927 bp, Homo sapiens
atgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcagctttttagacgcacagccaccaagccagcaaggtctgccgagattcagaaggacagagaactttctaccaaagagcaccagcccttctagattgtgtagcatttcatcaacaaaaatgactccaggagaccattcttgggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccgtcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccaacctgcccagctgctgccgctggaggatccggaaagagtttccgaagagtgaagggcagtacagtggcttcaagagtccttactga

SEQ ID NO: 25026 - DNA, 1578 bp, Homo sapiens
atgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccaacctgcccagctgctgccgctggaggatccggaaagagtttccgaagagtgaagggcagtacagtggcttcaagagtccttactga

SEQ ID NO: 25027 - DNA, 1578 bp, Homo sapiens; identical to SEQ ID NO: 25026

SEQ ID NO: 25028 - DNA, 1799 bp, Homo sapiens
atgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccgtcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggtaagagattctcttttccatgctttaggaaaatggtttggagaaggaagtgactaacgcagcgcttgtctgcattctccccaggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccaacctgcccagctgctgccgctggaggatccggaaagagtttccgaagagtgaagggcagtacagtggcttcaagagtccttactga

SEQ ID NO: 25029 - DNA, 2664 bp, Homo sapiens
gtcattggaggagcttgaagttaaagactcctgctaaaaaccagtacgtttcattttgcagttactgggagggggcttgctgtggccctgtcaggaagagtagagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccgtcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccaacctgcccagctgctgccgctggaggatccggaaagagtttccgaagagtgaagggcagtacagtggcttcaagagtccttactgaagccaggcaccgtggctcacgtctgtaatcccagcgctttgggaggccgaggcaggcagatcacctgaggtcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtcccccaaaaaaaaaaaagagtccttaccaatagcaggggctgcagtagccatgttaacatgacatttaccagcaacttgaacttcacctgcaaagctctgtggccacattttcagccaaagggaaatatgctttcatcttctgttgctctctgtgtctgagagcaaagtgacctggttaaacaaaccagaatccctctacatggactcagagaaaagagattgagatgtaagtctcaactctgtccccaggaagttgtgtgaccctaggcctctcacctctgtgcctctgtctccttgttgcccaactactatctcagagatattgtgaggacaaattgagacagtgcacatgaactgtcttttaatgtgtaaagatctacatgaatgcaaaacatttcattatgaggtcagactaggataatgtccaactaaaaacaaacccttttcatcctggct

SEQ ID NO: 25030 - DNA, 3106 bp, Homo sapiens
tcggcggagacctgctccccagaagacgcctcctgcttcccactgcgccctggaggacgcgggctggctgctgggcgagctcggcggaggcacgcccctcgcctccccgcggagtgcggactcgccccggtgcccaaactccgcccaccctctagggagctccgctctcccgcctaaccccggcactccggacagagctgggcctggggaaggggttcctgaactacgcggacgccgaacgggacgcgctgcagaagcgcacgagtctgcggccacgcgcgctccgatggctgccaggagctgagctcagggtgggcggaggaagcggttagacgccccgaaactgagctgcacgtttctaaggtagggaggaggaagatgcccccaattaagttgatctttgagccaaggaggctggggagcagcctccccaagctagagccctgcagagcgagtttcccttgacctcgctgcgcctctggcgcgctctgcagcgcggacccgcggcccctcgggaaagcgcagtcggaaagttatccgcggcggttccctgcgcgccctgttgtgtaagctcggcgttgccagcggacggagaagttgctggcttgcccgatagcccagttcggtggcggcccggggcggatttcatggcccgcggcgaacgcggggccagagctggcgtgggcgagcccctgcgcgccccctcccgcggggatccagttcgcctgctcccttccgctcgctggcttttccgatgcttgctgcgcccctggccgccgctgccctctcgccgcctcctacccctcggagccgccgcctaagtcgaggaggagagaatgaccgaggtgctgtggccggctgtccccaacgggacggacgctgccttcctggccggtccgggttcgtcctgggggaacagcacggtcgcctccactgccgccgtctcctcgtcgttcaaatgcgccttgaccaagacgggcttccagttttactacctgccggctgtctacatcttggtattcatcatcggcttcctgggcaacagcgtggccatctggatgttcgtcttccacatgaagccctggagcggcatctccgtgtacatgttcaatttggctctggccgacttcttgtacgtgctgactctgccagccctgatcttctactacttcaataaaacagactggatcttcggggatgccatgtgtaaactgcagaggttcatctttcatgtgaacctctatggcagcatcttgtttctgacatgcatcagtgcccaccggtacagcggtgtggtgtaccccctcaagtccctgggccggctcaaaaagaagaatgcgatctgtatcagcgtgctggtgtggctcattgtggtggtggcgatctcccccatcctcttctactcaggtaccggggtccgcaaaaacaaaaccatcacctgttacgacaccacctcagacgagtacctgcgaagttatttcatctacagcatgtgcacgaccgtggccatgttctgtgtccccttggtgctgattctgggctgttacggattaattgtgagagctttgatttacaaagatctggacaactctcctctgaggagaaaatcgatttacctggtaatcattgtactgactgtttttgctgtgtcttacatccctttccatgtgatgaaaacgatgaacttgagggcccggcttgattttcagaccccagcaatgtgtgctttcaatgacagggtttatgccacgtatcaggtgacaagaggtctagcaagtctcaacagttgtgtggaccccattctctatttcttggcgggagatactttcagaaggagactctcccgagccacaaggaaagcttctagaagaagtgaggcaaatttgcaatccaagagtgaagacatgaccctcaatattttacctgagttcaagcagaatggagatacaagcctgtgaaggcacaagaatctccaaacacctctctgttgtaatatggtaggatgcttaacagaatcaagtacttttcccctctttaactttctagtttagaaaaaaatcaaaccaagaaaatagtgagttaaaaaaataatagaagtagaaatgcccacatccacacttagcttgtttgggtttgctttcacagtctctcttccttctgactagaagtatgtataataaaacaatactacctagttaaacatttactttctcttttgcctttaaaatgtgcaggcttttctgtttaaagtgtgtgtgcacatgagtactggggctgtttttgatattagtaatttctctaagaaaactagccccctgcaacttgagtttgtggtttatctagcctttattgtttttttaaaatccacagtaggaataaaaaatctatattctcagaaatatctagcatggtatataacaaaacactaaactcatcagttcatccggcatcagatcaatggatctctgagcggggtgtttttttcagtgtcttataagcatagatgatagttgactgagtttctttagggcattgaatagacaagtaaagctaatgaatttaaaagcctgaaaagtgattgttttccagttatttctggaaaaggtctcattatatattgggtgctaaatgtttgatggggaaagcctgcatatattatcgtactggtaaaatgcattcaaaataattaaagtgcatgtattttccttgtaaacaccatgagctctcttagacatcttgtgataaagagcatttacttgccccactgctgtgcaatgccttaggactttgtttgtgttccaggacaagtgttcactcacatctgtaaaaacaattttaagaattgcaaataaattacagaccaaagattgagtaaagtcaaataactgttagtaagttgaaggatattggacaggaggacagtatttcagaaaaggagaggttgacagtcatccacaaggcatagcctccaagtatactctcaaatgtatgaagcaactggggtgggcagaagacattttagaatgagggctttagtttaaattaaagtcatggtggagaagactcttgcttcctccaagtgtttgaaaacacaaaatgcgatatg

SEQ ID NO: 25031 - DNA, 1943 bp, Homo sapiens
gaacctcaggagggttgtggcacaatgaggaaggaaacgtgggtggaaaggcacgctggcctgctctgctggctgggccagtaactggggatggggctggggcagggcccactaagccactggtgactgggggaggggctggggaactgggtagcagacacaggctgaggatcggcacgggagcatggcagccaacgtctcgggtgccaagtcctgccctgccaacttcttggcagctgccgacgacaaactcagtgggttccagggggacttcctgtggcccatactggtggttgagttcctggtggccgtggccagcaatggcctggccctgtaccgcttcagcatccggaagcagcgcccatggcaccccgccgtggtcttctctgtccagctggcagtcagcgacctgctctgcgccctgacgctgcccccgctggccgcctacctctatccccccaagcactggcgctatggggaggccgcgtgccgcctggagcgcttcctcttcacctgcaacctgctgggcagcgtcatcttcatcacctgcatcagcctcaaccgctacctgggcatcgtgcaccccttcttcgcccgaagccacctgcgacccaagcacgcctgggccgtgagcgctgccggctgggtcctggccgccctgctggccatgcccacactcagcttctcccacctgaagaggccgcagcagggggcgggcaactgcagcgtggccaggcccgaggcctgcatcaagtgtctggggacagcagaccacgggctggcggcctacagagcgtatagcctggtgctggcggggttgggctgcggcctgccgctgctgctcacgctggcagcctacggcgccctcgggcgggccgtgctacgcagcccaggcatgactgtggccgagaagctgcgtgtggcagcgttggtggccagtggtgtggccctctacgccagctcctatgtgccctaccacatcatgcgggtgctcaacgtggatgctcggcggcgctggagcacccgctgcccgagctttgcagacatagcccaggccacagcagccctggagctggggccctacgtgggctaccaggtgatgcggggcctcatgcccctggccttctgtgtccaccctctactctacatggccgcagtgcccagcctgggctgctgctgccgacactgccccggctacagggacagctggaacccagaggacgccaagagcactggccaagccctgcccctcaatgccacagccgcccctaaaccgtcagagccccagtcccgtgagctgagccaatgatgtggcctagcggaagctgcctcctcaccctaggtgttgctggagaaccctgagggcagggcccgagccccgacacatcccttcccccaaaaagcaacacctgtgcttgcagccaggtcaggcccagctgcagcccaggcaggagcagtcgcctttcccacccacagcgctggccacagggctccctgcagggtcagggaccagaccacgcccagaggaggggaggcactggcccccgccacaggactggagacgcaagaacaaaaagaaccaagtagagagagtggagctgctttattgcccttggagcccgcgctctcggaggctgtcttctgtcgccaagggtcccggaccgagtacacagtggcagctggcttagttggtggacggcctggggtaggggagggtggcaggtataagacttctgggggcaccccaagaccccagacacccaagtggcatcttgggggtgggtgggcagaggacggggtaatgtgaggacgaagcgggcacggagccagatggccagtctccaggcctggtccacggactggcagggaccccaggcacaagagctgccacccctctgcccggttttggaaaaaaacaataaaggactgtcccctcaaaacca

SEQ ID NO: 25032 - DNA, 1766 bp, Homo sapiens
actgttgttacacaacaaacatcatagtgctgaaatgacaaaaatccagggtagtgatcacaatcagaagacaggagctgcagaacagaacactttctcatgtccagggtcagattacaagagcactcaagactttactgacgaaaactcaggaaatcctctatcacaaagaggtttggcaactaaactaagacattaaaaggaaaataccagatgccactctgcaggttgcaataactactacttactggatacattcaaaccctccagaatcaacagttatcaggtaaccaacaagaaatgcaagccgtcgacaacctcacctctgcgcctggtaacaccagtctgtgcaccagagactacaaaatcacccaggtcctcttcccactgctctacactgtcctgttttttgttggacttatcacaaatggcctggcgatgaggattttctttcaaatccggagtaaatcaaactttattatttttcttaagaacacagtcatttctgatcttctcatgattctgacttttccattcaaaattcttagtgatgccaaactgggaacaggaccactgagaacttttgtgtgtcaagttacctccgtcatattttatttcacaatgtatatcagtatttcattcctgggactgataactatcgatcgctaccagaagaccaccaggccatttaaaacatccaaccccaaaaatctcttgggggctaagattctctctgttgtcatctgggcattcatgttcttactctctttgcctaacatgattctgaccaacaggcagccgagagacaagaatgtgaagaaatgctctttccttaaatcagagttcggtctagtctggcatgaaatagtaaattacatctgtcaagtcattttctggattaatttcttaattgttattgtatgttatacactcattacaaaagaactgtaccggtcatacgtaagaacgaggggtgtaggtaaagtccccaggaaaaaggtgaacgtcaaagttttcattatcattgctgtattctttatttgttttgttcctttccattttgcccgaattccttacaccctgagccaaacccgggatgtctttgactgcactgctgaaaatactctgttctatgtgaaagagagcactctgtggttaacttccttaaatgcatgcctggatccgttcatctattttttcctttgcaagtccttcagaaattccttgataagtatgctgaagtgccccaattctgcaacatctctgtcccaggacaataggaaaaaagaacaggatggtggtgacccaaatgaagagactccaatgtaaacaaattaactaaggaaatatttcaatctctttgtgttcagaactcgttaaagcaaagcgctaagtaaaaatattaactgacgaagaagcaactaagttaataataatgactctaaagaaacagaagattacaaaagcaattttcatttacctttccagtatgaaaagctatcttaaaatatagaaaactaatctaaactgtagctgtattagcagcaaaacaaacgacatccaattgtcatgctgcatgcaaaactacacagaattcatgttttgcagagttttgccaaaatgagtaatcatataatatttactgtaatttttaaaatacattatcgttcacaattttattttttcataatcaactaaggaagaacgatcaattggatataatcttcttaccaaaaatgatagttaaaatgtatatatatcctagt

SEQ ID NO: 25033 - DNA, 1348 bp, Homo sapiens
acaatcagaagacaggagctgcagaacagaacactttctcatgtccagggtcagattacaagagcactcaagactttactgacgaaaactcaggaaatcctctatcacaaagaggtttggcaactaaactaagacattaaaaggaaaataccagatgccactctgcaggttgcaataactactacttactggatacattcaaaccctccagaatcaacagttatcaggtaaccaacaagaaatgcaagccgtcgacaacctcacctctgcgcctggtaacaccagtctgtgcaccagagactacaaaatcacccaggtcctcttcccactgctctacactgtcctgttttttgttggacttatcacaaatggcctggcgatgaggattttctttcaaatccggagtaaatcaaactttattatttttcttaagaacacagtcatttctgatcttctcatgattctgacttttccattcaaaattcttagtgatgccaaactgggaacaggaccactgagaacttttgtgtgtcaagtcattttctggattaatttcttaattgttattgtatgttatacactcattacaaaagaactgtaccggtcatacgtaagaacgaggggtgtaggtaaagtccccaggaaaaaggtgaacgtcaaagttttcattatcattgctgtattctttatttgttttgttcctttccattttgcccgaattccttacaccctgagccaaacccgggatgtctttgactgcactgctgaaaatactctgttctatgtgaaagagagcactctgtggttaacttccttaaatgcatgcctggatccgttcatctattttttcctttgcaagtccttcagaaattccttgataagtatgctgaagtgccccaattctgcaacatctctgtcccaggacaataggaaaaaagaacaggatggtggtgacccaaatgaagagactccaatgtaaacaaattaactaaggaaatatttcaatctctttgtgttcagaactcgttaaagcaaagcgctaagtaaaaatattaactgacgaagaagcaactaagttaataataatgactctaaagaaacagaagattacaaaagcaattttcatttacctttccagtatgaaaagctatcttaaaatatagaaaactaatctaaactgtagctgtattagcagcaaaacaaacgacatccaattgtcatgctgcatgcaaaactacacagaattcatgttttgcagagttttgccaaaatgagtaatcatataatatttactgtaatttttaaaatacattatcgttcacaattttattttttcataatcaactaa

SEQ ID NO: 25034 - DNA, 2660 bp, Homo sapiens
gaacagcgcagggaggtgggtagccgggctcccaggcacgtgggtctctgcggctgcggcgggacccgggcactggcacccgggagcggcggcgacggcaccctgagaggagaagcgcagcgcagtggcgagaggagccccttgtggcagcagcactacctgcccagaaaaatgctggaggctgggcgtggccccaggcctggggacctgtttttcctgtttcccgcagagttccctgcagcccggtccaggtccaggcgtgtgcattcatgagtgaggaacccgtgcaggcgctgagcatcctgacctggagagcaggggctggtcaggttccagagcttggaggttccaggtccagatccaagtcagatggcaatgaaagccctggtcaggtggctgtgtcaggtcccctaggggcgctccggccacaaccctgatggccccacccctcccttccctgcagggcgatggcagcagacctgggcccctggaatgacaccatcaatggcacctgggatggggatgagctgggctacaggtgccgcttcaacgaggacttcaagtacgtgctgctgcctgtgtcctacggcgtggtgtgcgtgcctgggctgtgtctgaacgccgtggcgctctacatcttcttgtgccgcctcaagacctggaatgcgtccaccacatatatgttccacctggctgtgtctgatgcactgtatgcggcctccctgccgctgctggtctattactacgcccgcggcgaccactggcccttcagcacggtgctctgcaagctggtgcgcttcctcttctacaccaacctttactgcagcatcctcttcctcacctgcatcagcgtgcaccggtgtctgggcgtcttacgacctctgcgctccctgcgctggggccgggcccgctacgctcgccgggtggccggggccgtgtgggtgttggtgctggcctgccaggcccccgtgctctactttgtcaccaccagcgcgcgcgggggccgcgtaacctgccacgacacctcggcacccgagctcttcagccgcttcgtggcctacagctcagtcatgctgggcctgctcttcgcggtgccctttgccgtcatccttgtctgttacgtgctcatggctcggcgactgctaaagccagcctacgggacctcgggcggcctgcctagggccaagcgcaagtccgtgcgcaccatcgccgtggtgctggctgtcttcgccctctgcttcctgccattccacgtcacccgcaccctctactactccttccgctcgctggacctcagctgccacaccctcaacgccatcaacatggcctacaaggttacccggccgctggccagtgctaacagttgccttgaccccgtgctctacttcctggctgggcagaggctcgtacgctttgcccgagatgccaagccacccactggccccagccctgccaccccggctcgccgcaggctgggcctgcgcagatccgacagaactgacatgcagaggatagaagatgtgttgggcagcagtgaggactctaggcggacagagtccacgccggctggtagcgagaacactaaggacattcggctgtaggagcagaacacttcagcctgtgcaggtttatattgggaagctgtagaggaccaggacttgtgcagacgccacagtctccccagatatggaccatcagtgactcatgctggatgaccccatgctccgtcatttgacaggggctcaggatattcactctgtggtccagagtcaactgttcccataacccctagtcatcgtttgtgtgtataagttgggggaattaagtttcaagaaaggcaagagctcaaggtcaatgacacccctggcctgactcccatgcaagtagctggctgtactgccaaggtacctaggttggagtccagcctaatcaagtcaaatggagaaacaggcccagagaggaaggtggcttaccaagatcacataccagagtctggagctgagctacctggggtgggggccaagtcacaggttggccagaaaaccctggtaagtaatgagggctgagtttgcacagtggtctggaatggactgggtgccacggtggacttagctctgaggagtacccccagcccaagagatgaacatctggggactaatatcatagacccatctggaggctcccatgggctaggagccagtgtgaggctgtaacttatactaaaggttgtgttgcctgctgagctgtgccctattgtgtggtcgggggatgaggatatggcagggaagctttcaccagccacacaagggtcctttctccaatccgttcccttctgccacctgccttctcactagctgtctcaggagtagtctcatatcagggatcctctctccaggccccaggtcatcccccactgtaaagccagttggcttctgtgcctgactctgtgctgagcacagagaaaagtcaggtgcagtcccagtccttgagatttcccagtttaggtgatggccagtcatgtgctggtaaatgttaagccatttaactggagctccgatttaactgggaaccccttctttgtagaactgcccatttccatggtgcaaaaactcttatggccaaattcaaactataaacatgatgtcaacttccttgtaaaa

SEQ ID NO: 25035 - DNA, 2174 bp, Homo sapiens
caaggcgctgggagaggcccggggaagcggcgggccagactggcgcaggtgcggactgggcgcggggcaggggagggcgctgtggagcggctgtcgccccggggcacagttgcgagccggcgtgtagcgcataactggacggcttgaacgcgcctgtgggtccgtggttgaactttgtctccacgggagcgtcggtctcggagccccttgtggcagcagcactacctgcccagaaaaatgctggaggctgggcgtggccccaggcctggggacctgtttttcctgtttcccgcagagttccctgcagcccggtccaggtccaggcgtgtgcattcatgagtgaggaacccgtgcaggcgctgagcatcctgacctggagagcaggggctggtcagggcgatggcagcagacctgggcccctggaatgacaccatcaatggcacctgggatggggatgagctgggctacaggtgccgcttcaacgaggacttcaagtacgtgctgctgcctgtgtcctacggcgtggtgtgcgtgcctgggctgtgtctgaacgccgtggcgctctacatcttcttgtgccgcctcaagacctggaatgcgtccaccacatatatgttccacctggctgtgtctgatgcactgtatgcggcctccctgccgctgctggtctattactacgcccgcggcgaccactggcccttcagcacggtgctctgcaagctggtgcgcttcctcttctacaccaacctttactgcagcatcctcttcctcacctgcatcagcgtgcaccggtgtctgggcgtcttacgacctctgcgctccctgcgctggggccgggcccgctacgctcgccgggtggccggggccgtgtgggtgttggtgctggcctgccaggcccccgtgctctactttgtcaccaccagcgcgcgcgggggccgcgtaacctgccacgacacctcggcacccgagctcttcagccgcttcgtggcctacagctcagtcatgctgggcctgctcttcgcggtgccctttgccgtcatccttgtctgttacgtgctcatggctcggcgactgctaaagccagcctacgggacctcgggcggcctgcctagggccaagcgcaagtccgtgcgcaccatcgccgtggtgctggctgtcttcgccctctgcttcctgccattccacgtcacccgcaccctctactactccttccgctcgctggacctcagctgccacaccctcaacgccatcaacatggcctacaaggttacccggccgctggccagtgctaacagttgccttgaccccgtgctctacttcctggctgggcagaggctcgtacgctttgcccgagatgccaagccacccactggccccagccctgccaccccggctcgccgcaggctgggcctgcgcagatccgacagaactgacatgcagaggatagaagatgtgttgggcagcagtgaggactctaggcggacagagtccacgccggctggtagcgagaacactaaggacattcggctgtaggagcagaacacttcagcctgtgcaggtttatattgggaagctgtagaggaccaggacttgtgcagacgccacagtctccccagatatggaccatcagtgactcatgctggatgaccccatgctccgtcatttgacaggggctcaggatattcactctgtggtccagagtcaactgttcccataacccctagtcatcgtttgtgtgtataagttgggggaattaagtttcaagaaaggcaagagctcaaggtcaatgacacccctggcctgactcccatgcaagtagctggctgtactgccaaggtacctaggttggagtccagcctaatcaagtcaaatggagaaacaggcccagagaggaaggtggcttaccaagatcacataccagagtctggagctgagctacctggggtgggggccaagtcacaggttggccagaaaaccctggtaagtaatgagggctgagtttgcacagtggtctggaatggactgggtgccacggtggacttagctctgaggagtacccccagcccaagagatgaacatctggggactaatatcatagacccatctggaggctcccatgggctaggagccagtgtgaggctgtaacttatactaaaggttgtgttgcctgctga

SEQ ID NO: 25036 - DNA, 2107 bp, Homo sapiens
ggaacagcgcagggaggtgggtagccgggctcccaggcacgtgggtctctgcggctgcggcgggacccgggcactggcacccgggagcggcggcgacggcaccctgagaggagaagcgcagcgcagtggcgagaggagccccttgtggcagcagcactacctgcccagaaaaatgctggaggctgggcgtggccccaggcctggggacctgtttttcctgtttcccgcagagttccctgcagcccggtccaggtccaggcgtgtgcattcatgagtgaggaacccgtgcaggcgctgagcatcctgacctggagagcaggggctggtcagggcgatggcagcagacctgggcccctggaatgacaccatcaatggcacctgggatggggatgagctgggctacaggtgccgcttcaacgaggacttcaagtacgtgctgctgcctgtgtcctacggcgtggtgtgcgtgcctgggctgtgtctgaacgccgtggcgctctacatcttcttgtgccgcctcaagacctggaatgcgtccaccacatatatgttccacctggctgtgtctgatgcactgtatgcggcctccctgccgctgctggtctattactacgcccgcggcgaccactggcccttcagcacggtgctctgcaagctggtgcgcttcctcttctacaccaacctttactgcagcatcctcttcctcacctgcatcagcgtgcaccggtgtctgggcgtcttacgacctctgcgctccctgcgctggggccgggcccgctacgctcgccgggtggccggggccgtgtgggtgttggtgctggcctgccaggcccccgtgctctactttgtcaccaccagcgcgcgcgggggccgcgtaacctgccacgacacctcggcacccgagctcttcagccgcttcgtggcctacagctcagtcatgctgggcctgctcttcgcggtgccctttgccgtcatccttgtctgttacgtgctcatggctcggcgactgctaaagccagcctacgggacctcgggcggcctgcctagggccaagcgcaagtccgtgcgcaccatcgccgtggtgctggctgtcttcgccctctgcttcctgccattccacgtcacccgcaccctctactactccttccgctcgctggacctcagctgccacaccctcaacgccatcaacatggcctacaaggttacccggccgctggccagtgctaacagttgccttgaccccgtgctctacttcctggctgggcagaggctcgtacgctttgcccgagatgccaagccacccactggccccagccctgccaccccggctcgccgcaggctgggcctgcgcagatccgacagaactgacatgcagaggatagaagatgtgttgggcagcagtgaggactctaggcggacagagtccacgccggctggtagcgagaacactaaggacattcggctgtaggagcagaacacttcagcctgtgcaggtttatattgggaagctgtagaggaccaggacttgtgcagacgccacagtctccccagatatggaccatcagtgactcatgctggatgaccccatgctccgtcatttgacaggggctcaggatattcactctgtggtccagagtcaactgttcccataacccctagtcatcgtttgtgtgtataagttgggggaattaagtttcaagaaaggcaagagctcaaggtcaatgacacccctggcctgactcccatgcaagtagctggctgtactgccaaggtacctaggttggagtccagcctaatcaagtcaaatggagaaacaggcccagagaggaaggtggcttaccaagatcacataccagagtctggagctgagctacctggggtgggggccaagtcacaggttggccagaaaaccctggtaagtaatgagggctgagtttgcacagtggtctggaatggactgggtgccacggtggacttagctctgaggagtacccccagcccaagagatgaacatctggggactaatatcatagacccatctggaggctcccatgggctaggagccagtgtgaggctgtaacttatactaaaggttgtgttgcctgct

SEQ ID NO: 25037 - DNA, 4198 bp, Homo sapiens
ggaagggcagccgtctgccgcccacgaacaccttctcaagcactttgagtgaccacggcttgcaagctggtggctggccccccgagtcccgggctctgaggcacggccgtcgacttaagcgttgcatcctgttacctggagaccctctgagctctcacctgctacttctgccgctgcttctgcacagagcccgggcgaggacccctccaggatgcaggtcccgaacagcaccggcccggacaacgcgacgctgcagatgctgcggaacccggcgatcgcggtggccctgcccgtggtgtactcgctggtggcggcggtcagcatcccgggcaacctcttctctctgtgggtgctgtgccggcgcatggggcccagatccccgtcggtcatcttcatgatcaacctgagcgtcacggacctgatgctggccagcgtgttgcctttccaaatctactaccattgcaaccgccaccactgggtattcggggtgctgctttgcaacgtggtgaccgtggccttttacgcaaacatgtattccagcatcctcaccatgacctgtatcagcgtggagcgcttcctgggggtcctgtacccgctcagctccaagcgctggcgccgccgtcgttacgcggtggccgcgtgtgcagggacctggctgctgctcctgaccgccctgtccccgctggcgcgcaccgatctcacctacccggtgcacgccctgggcatcatcacctgcttcgacgtcctcaagtggacgatgctccccagcgtggccatgtgggccgtgttcctcttcaccatcttcatcctgctgttcctcatcccgttcgtgatcaccgtggcttgttacacggccaccatcctcaagctgttgcgcacggaggaggcgcacggccgggagcagcggaggcgcgcggtgggcctggccgcggtggtcttgctggcctttgtcacctgcttcgcccccaacaacttcgtgctcctggcgcacatcgtgagccgcctgttctacggcaagagctactaccacgtgtacaagctcacgctgtgtctcagctgcctcaacaactgtctggacccgtttgtttattactttgcgtcccgggaattccagctgcgcctgcgggaatatttgggctgccgccgggtgcccagagacaccctggacacgcgccgcgagagcctcttctccgccaggaccacgtccgtgcgctccgaggccggtgcgcaccctgaagggatggagggagccaccaggcccggcctccagaggcaggagagtgtgttctgagtcccgggggcgcagcttggagagccgggggcgcagcttggagatccaggggcgcatggagaggccacggtgccagaggttcagggagaacagctgcgttgctcccaggcactgcagaggcccggtggggaagggtctccaggctttattcctcccaggcactgcagaggcaccggtgaggaagggtctccaggcttcactcagggtagagaaacaagcaaagcccagcagcgcacagggtgcttgttatcctgcagagggtgcctctgcctctctgtgtcaggggacagcttgtgtcaccacgcccggctaatttttgtattttttttagtagagctgggctgtcacccccgagctccttagacactcctcacacctgtccatacccgagggtggatattcaaccagccccaccgcctacccgactcggtttctggatatcctccgtgggcgaactgcgagccccattcccagctcttctccctgctgacatcgtcccttagttgtggttctggccttctccattctcctccaggggttctggtctccgtagcccggtgcacgccgaaatttctgtttatttcactcaggggcactgtggttgctgtggttggaattcttctttcagaggagcgcctggggctcctgcaagtcagctactctccgtgcccacttccccccacacacacaccccaccctgttgctgaccaaggtgatttttggcacatttgttctggcctggcttggtgggaccccacccctattctgcttctgtgagtccctgatagagaaggaggtcccatcaggcccctggaacacactcaggcttccctgactcaggacaaggaccacgggaggcccaggtgcggaaaggaggctccgtgagatggggtccagcccatcccaacacaagggtgcagcttgattcgggagttccccacctcctgcccattctccgcgtccttttaccccatggagagcctcagccatggcaagtccatctggagtccaggaagcaggcaactggcctgacccatgagaccgtttggagaccaagcagcagatgcaggtgtggaccccaggaacctacaggggtgtcagccgctgagccccctccctgctgtgtgggtggtgagcaggctgggtctttgtctgtcttcttctacacggcatgtgcctgcaccagccccaacacctgagctggtttagcgcaaagaagagctctgactctccaggggtgctgggacatcacgtggaattggatcccaggctctcttgggcgagaaagaccattctggaggtgggagtgggagagctgcctgtctgcccacgggctctgcgtctccgcagtgggtggccttggatgcccggcccctccctttctgtgcactggggacgctgatggaggctgaagctgctgttcggaggccctctattggtgcctctctcctgccgtcatcactatggcaggaaaacagagatggtttagtaatgaattatcattcccaaacccgtgtccacctggaacatcaggatgggaccatgtttgaaaatcgggtctttccaaatgtaattaagtaaggcgaggccatactgcatttacaatgggcccaatccagtgtccctatgagagacggaagaggagacacagacacaaagcaggaggccacataaagacagaggcagagactgaagtgatgctgccccaagcccagggatgcctggagtccccaggagctgggagaggcaggaaggaccctcccctagagtctctggagggaactggatacaattgcagagtgcactaaacagttgccccagaaagacatgtcttgttttaaagcccagaacctgaaattattatagattttattcggtaataaggaactttgcatgtgtaattacttaaggatatgaagatgagattgtgctggattattaagcaccctaaatgccatgacaggtgtccttccaagagacagaagaggagacacagacacagagcaggaggacacgtggagacagaggcagactggagtgatgcggccacaagcccagggacacctggagcccccaggagctgggagaggcaggaaggatcctcccctagagcctccagggggaactggaggatgcgtaagagacccagaacttccacagaaggaggaaaattaacctcctgcttctctagactgttccaaagctgaaccctagaaagcaaagctgatacagaagcatccaggctgcaggagtacaggtcgcaagtgctgagcgtgggccttgggtgtgtctcatgggggaaaaaaaactgtgaaaaacctcagagtagcatcttcacagtaacgcacggacgatccctaaactgccttgtaaacaaaaatgagagcttgagtcagaggaagccgagacaatatccttcctcgacaacgtgcgagaaccctgacgtcccccagcaaaggaagacgttgcaagcaggcaaaatgcgtcgattttttttttttgtcagtatgatgatttttgcagccacttggctatggagagcagccgacaccccctcttacagccgtggatgtttcctggaagctgactcagtctgttcactggttgagctttgagtgaaaagataacacaggtctattgactcacacacatgttttaagatggaaaactttacttctgttcttggcaggacatggagagagggagggattccaaaaagtctcagcctccatcaaggcgtggcagctcatgccggtaatctcagcactttgggaggctcaggcgggaggactgattgagtccgggtgttcaagggccaacctaggcaacacagtgagaactcatctctgtaaaaaataaaaataaaacattaaaaaaaaacatgagctttgaagtgcacagggcaaa

SEQ ID NO: 25038 - DNA, 660 bp, Homo sapiens
gcccctggtgctctcagatgtcggccaggcttgcagacaggtgaatgcatctcattggctccagggaggcatgatgccaccgggcagctctttttaagagaaaagccagaaccggtggagcagcgacccctgagcagtgttctctgtgctgagcggcgggactgagctgttgagttagagccaacatgagtgagcgacaaggtgctggggcaaccaatggaaaagacaagacatctggtgaaaatgatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgaattcaa

SEQ ID NO: 25039 - DNA, 2747 bp, Homo sapiens
gtcactgcatcccggcgcggcccgcagaagacgagcgccgctgccgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggtaaaagtttcacatctgctttaaggaaaaatgaaaattctattatagagttcactttctgttttagacttaggtcactgtccttaagtatgtatttttaatgcatctacattttttactattttggatgtttggtaatttttctaacttttcaaaatgggaatacaagtaattctgaagtcctttcaaactgtaagatcgctctaattttagttggtaattattaattgataataaaactatcatatggttgcaaaa

SEQ ID NO: 25040 - DNA, 3085 bp, Homo sapiens
ctctccggcgtctccgcctggaggggaagatgcggcctgcctggcccgccgcctcgcccccggcctcacggtgggaccccgggcactgaggacggaggtcccgggcgccggcccgcggggcaacgggcactaggtgagagccggacgcgggcgagcgaaggaggcgggtgccgggcgactccagcggcggcccctgcccctcccccgcacccacgaacacgctcgcccgatatattgcagaggcttctccggtcgccgctgcgccagtttttttttgtttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagtaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagactttc

SEQ ID NO: 25041 - DNA, 2603 bp, Homo sapiens
ctctccggcgtctccgcctggaggggaagatgcggcctgcctggcccgccgcctcgcccccggcctcacggtgggaccccgggcactgaggacggaggtcccgggcgccggcccgcggggcaacgggcactaggtgagagccggacgcgggcgagcgaaggaggcgggtgccgggcgactccagcggcggcccctgcccctcccccgcacccacgaacacgctcgcccgatatattgcagaggcttctccggtcgccgctgcgccagtttttttttgtttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagaatttggaagcactcgtct

SEQ ID NO: 25042 - DNA, 3000 bp, Homo sapiens
tggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagtaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagact

SEQ ID NO: 25043 - DNA, 3075 bp, Homo sapiens
gctgccgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagtaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagact

SEQ ID NO: 25044 - DNA, 3273 bp, Homo sapiens
gtcactgcatcccggcgcggcccgcagaagacgagcgccgctgccgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagtaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagact

SEQ ID NO: 25045 - DNA, 3244 bp, Homo sapiens
ctctccggcgtctccgcctggaggggaagatgcggcctgcctggcccgccgcctcgcccccggcctcacggtgggaccccgggcactgaggacggaggtcccgggcgccggcccgcggggcaacgggcactaggtgagagccggacgcgggcgagcgaaggaggcgggtgccgggcgactccagcggcggcccctgcccctcccccgcacccacgaacacgctcgcccgatatattgcagaggcttctccggtcgccgctgcgccagtttttttttgtttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagtaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagactttc

SEQ ID NO: 25046 - DNA, 1063 bp, Homo sapiens
ggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacaggtcagtggagaaataaggaaaattttttacctgtttttgtatatgatattccattgagttgcttttgttctcttgatttggtctctcttcaagttgatgtgggcaataaaggattgataagtgga

SEQ ID NO: 25047 - DNA, 770 bp, Homo sapiens
ggcctctccggcgtctccgcctggaggggaagatgcggcctgcctggcccgccgcctcgcccccggcctcacggtgggaccccgggcactgaggacggaggtcccgggcgccggcccgcggggcaacgggcactaggtgagagccggacgcgggcgagcgaaggaggcgggtgccgggcgactccagcggcggcccctgcccctcccccgcacccacgaacacgctcgcccgatatattgcagaggcttctccggtcgccgctgcgccagtttttttttgtttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttacta

SEQ ID NO: 25048 - DNA, 1505 bp, Homo sapiens
ttgtttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgact

SEQ ID NO: 25049 - DNA, 3292 bp, Homo sapiens
gtgggcggtgcacgccgtcgcttcccggaagtgcgtgctgtgggcggtgccgcgcggacccccgggaagtgtctctgtgggcggccgccgggttgagctgcggcacacgtgcgacggccgtgatgaagttcgcttaccggttttcaaatttgctgggtacggtgtaccggcgtgggaacctaaattttacctgcgatggaaattcagttatcagtcccgtgggcaatagagtcactgtatttgaccttaaaaacaacaaatctgacacgctgcccctggccactcggtacaacgtcaagtgcgtggggctgtccccggatggccgcctcgctatcatcgtcgatgaagggggcgatgcgctgctggtcagcctggtctgcaggtctgtgctgcaccacttccacttcaagggctctgtgcacagtgtgtccttctcccctgatggcaggaagtttgttgtcacaaagggtaacattgcccagatgtatcatgcccctgggaagaagcgggagttcaacgccttcgttctggacaagacctattttgggccctacgatgagaccacctgcatcgactggacggatgactccaggtgctttgtggttgggagcaaagacatgtccacctgggtgttcggagccgagcgctgggacaacctcatctactatgcactggggggacataaggatgccatcgtggcctgcttctttgaatccaacagcctggacctgtactcactcagccaggacggagtgctgtgcatgtggcagtgtgacacgccccccgagggcttgcggctgaagccccctgcgggctggaaagcagacctgttgcagcgggaggaggaagaggaggaggaggaggaccaggagggcgacagagagaccaccatccggggaaaagccactccggccgaggaggagaagacaggaaaagtgaagtactcacggctggccaagtacttcttcaataaagaaggggattttaacaacctgacagctgcagcatttcataagaagtctcacctcttggtcactggctttgcttctggaatcttccatcttcatgagctgccagagtttaacctcatccactccctgagcatttcagatcagagcatcgcctcagtggccatcaatagctcgggggactggattgcttttggctgttcaggcctgggccagctgctggtgtgggagtggcagagtgagtcctacgtgctcaagcagcagggccacttcaacagcatggtggccctggcctactcgcccgacggacagtacatcgtgactggcggggacgacggcaaggtcaaggtgtggaacaccctcagcggcttctgcttcgtcacttttacggagcactccagcggggtgaccggtgtgacctttactgccaccggctacgttgtggtgacctcatccatggacgggaccgtgcgagcctttgaccttcacaggtaccgaaacttccgcaccttcacctctccacgccccacccagttctcctgtgtggcggtggatgcgagcggtgagatcgtctctgcaggggcgcaggactcctttgagattttcgtgtggtccatgcagacaggcaggctccttgatgttttgtctggacacgaagggcccatcagtggtctgtgttttaacccaatgaagtccgtcctggccagtgcctcctgggacaagacagtgcgcctatgggacatgtttgacagctggaggaccaaggagacgctggccctgacctctgatgctctggctgtgacttttcgccctgatggtgcggagctggctgtggccacactgaactcacagatcaccttctgggaccctgagaacgcggtgcagacgggctccattgagggcaggcatgacctcaagactggcaggaaggagctggacaagattacagccaagcacgcggccaaggggaaggccttcaccgccctgtgctactctgcagacggccacagcatcctggcgggaggcatgtccaagttcgtgtgcatctaccacgtccgtgagcagattctcatgaagaggttcgagatctcttgcaacctgtctttggacgccatggaggaatttttgaaccgaagaaaaatgacagagtttggcaacctggcactaattgatcaggatgctgggcaggaggatggagtcgcgataccactgccaggcgtcaggaaaggtgacatgagttctcggcacttcaaacctgagatcagggtgacctcactccgcttctctcccactgggcgctgctgggcggccaccaccacggagggactcctcatctactccctggacacccgcgtgctctttgacccgtttgagctggacaccagcgtcacccccgggagggtgcgcgaggcactgcgccagcaggacttcaccagggccatcctcatggccctccggctcaacgagagcaaactggtgcaggaggccctggaggcggtgcccaggggcgagattgaagtggtcacctcctcccttcctgaactgtatgtggagaaagtgctggagtttttagcttcctcctttgaagtgtctcgccacctggaattctacctcctctggactcacaaactgctcatgttgcacggacagaagctgaagtccagagccgggacgctgctgcctgtcattcagttcctccagaagagcatccagcggcacctggacgacctgtcgaaactctgtagctggaaccactataacatgcagtacgcactagcagtttccaagcagcggggcacaaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccagggagatgggacccttgtgccacctgggccagcaaagaggaggggtccagagaacagctgaaatactgtcactagtggtagtgacttgcttttcctgtgcacacatgtagcccatcaggacagcgagccgacgggtcacgccaggggccggcacgcactggcacctggccccaggagcggggccgtgtgaacggtgatgaatgttgaaaatgcgtctcagagaggtattcacatgaactttgtatgagacttatttatatctttaacataaaggtttgataaagaacttagggattaaaaaaaagatggagttttctaacgtgaggatgaagtctacacttcagattaaaaagggttatgttgta

SEQ ID NO: 25050 - DNA, 1976 bp, Homo sapiens
gtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacgattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcat

SEQ ID NO: 25051 - DNA, 2037 bp, Homo sapiens
ggggcggcgcgtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcat

SEQ ID NO: 25052 - DNA, 1928 bp, Homo sapiens
gtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacgattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcat

SEQ ID NO: 25053 - DNA, 2031 bp, Homo sapiens
gaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttgaacgtgaattttcggtaaagtaaactatgctgatttctcagactttaaagatgctctgtttctgtgtgtgaaataggacccaaagtgtctcgattgctgaagtgatgaacaagtgggaaagcagatttgagactatttccttatctgaatatttaaatgaaatacagcatctttaaaaagcacccagtgacttcatctatattcatttcattttcatcatgaccttcaaaatcttcattttcactctgatttcagttttaaaatacagctctaaaacctgcaaatcaactgcatggcattttggtatattttaattttggaaaccataactctcaaagtcccgttgctgcaaaaatgttgattcctagttactctgatgaagaggaaagagtgttaggcacttgag

SEQ ID NO: 25054 - DNA, 1635 bp, Homo sapiens
gcgtccctaggcggcggcggccgggcgtcccgggatggccttcatggagaagccgccagccggcaaggtgctgctggacgacacggtgccgctgacagcagccatcgaggcgagccagagcctgcagtcccacacgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcg

SEQ ID NO: 25055 - DNA, 2495 bp, Homo sapiens
taattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttgaacgtgaattttcgggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcaggtcattgttacaacagaagtaaatttggcatctatagaaatcaattatgatttttgaaagatttatctaaatatatcaatatagcatctctttaatgttagtcatttattagaaagatcctttatcctgatttgcttaaacctttcaataaattgcactttaaaggattataaataatccatttaaaaattcaagtacacacatcagtgttggttactatgcagagaatgtcattgtgtatagtttcatgtaatctgttatgtcagctgtattttttattaaaatcatgtc

SEQ ID NO: 25056 - DNA, 1306 bp, Homo sapiens
gcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctcc

SEQ ID NO: 25057 - DNA, 3146 bp, Homo sapiens
gtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatccca

SEQ ID NO: 25058 - DNA, 7366 bp, Homo sapiens
cggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctgccttgatttcagccacacccctgcagccctgcatcccagctctggggtgtgcagaggtttgtgtctccagggaacccacggctggagagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttcttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcctgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgtaaggatgaattccacaataggatcctttttaaaatcgattttaaattgttgcctagtcctgccaaggttattatgtgcatctgttatttttccaatacatgtaaacagttgcagcatgatgctttgtttaatgtcctgttcttaagctcgttagagccagttttgaaacgtttggtcttaccgtgaacggaggctggcttggcttagccacgctgatgagtaagtgagggatgtctccatcttgagatcaccaggcaagagagttgcctgcaccaggtaagaggccaaagcccctggggtaacagtccccaccgctacccgaggtaaaacaataaaagctatgtggttgagctcaggcctctcgtgcctggtgtcagagaaggcagagcccacagtaggtgcacggtgcaaggccctgggagggcactggccagggaaggtggtatagatggccctcagattgcggggccccgagcagctccccactctgcccgtccaccttccctggctccagcctcattctctctttagtttaactatgcaaagagaggaggttgagagtgttctggcagctggagctcttttccttgtccttcctgccctccgatggggccacctgtgtcggggcagcagtgtccatgtttatggagatcagaggtgtccccactgtgtggctggactgtactctgctgcccgggtagccaggagtctctccctctctcccctgccgcctgcctggtctcatgggcctccttcacacacccctccctgtggatcgcctgcctgggcccagagcaggggaactggagtttgtgagtgagcagagcaggttatgtgcagacagggaaacgagaactttggacctggctttctgagtccaggtgagagctgtgtggccccccgatgccactctgcccgccggagggatgtgcctgctgagccttttccttccacgccgcctctcactgccaggccagcggcttccgctgagactcgctggagaggcggctcccgtgtccgtccaccgagcactcagatggatgctgatcaccagggccgagggggctcccagaaggaccccaggccctggggagggtggctgtgggaggccaagtccactgcccggaagtcttgtcagccctaagccagggaagcctggagcgtggcctggcgggtctgggtggacaccgtccccactccggactcccagcacaggggaggatacctgagcctgtatggccctgtagccctgggcagagctgggcctgtcgtgtgttcctgcctggcaggtgcaggtgctggccatctgcaggtggaaggaggtgggaatcttggattttttgtttttttttgtttttttttttttgaggtgaagtctcgctctgacacccaggctggcgtgcagtggtgtgatctcggctcactgcaaactccgcttcctgggttcaagtggttctcctgccccagcctcccaagtagctgggattacaggcatgcgccaccacgctcagctgatttttgtatttttagtagagatggggtttcaccatgttggccaagctggtctcaaactcctgacctcaagtgatctgcccgcctcggcctcccagagtgctgggattacaggcatgagccagtgcacccggcggaatcttggaatttttatagacagcacctcagtttctgactccagccgcacacctcctgcctctgccagcaggggttgccgccagaccagagccagggccaggtccctgcgtccatcccccccggtaggatggacgtgagccatccttctaggggacttttttcagtgtgcgactcgtctctgttaggtggtaggagccagtttgtgtggcctgtgccacgctccacagtgcgtggctgggctctgtgtgtggcctgtgtcccctgtccctgcaggacccagcaggcatcgtggcgtgacagctgtgtccaagccactgcccgggcatcccatcacccaccagggtgcacggtctctcctgctgggggctttctgtcgcatgtgtgtctcctgtcgactctgcagtttgttctcagagcagaatgtttcctgttctcagtgcacaaagacactggttttcaatcggcgtctaaaaccacgttcctgcctttcattgcaacacggtgtgttcatttgtttaaaacagtttaatgagtaagtttagatgactggtcaatatcttaaaaatgtatattagtaagaagttcttcctggaatttttctttcgattctggcagaataaacaggtgtttttagttttcccactgtctgagccaagcaggaccctgtcccagagcaagagatgtccccttccatctctgacccttgcctgggacaagctttgatggggggccccagcttcaaggctgtggtgggaacagcacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcggataggtgggtgggaacagagaggggagaatgccgtcctaagcttctgcttggggatcccccacacgacctgggtactgcctgggaaacctgtcctaagtaaaactatggacctcgcctcgcccaccggcctgcgaagccagcatctccgtgaaggtggatggaagcgcctttgtcctcattttgagctgcaagctgggtcagcggctctgaagccctcgagtgactttctaacccaagacccagcccctggcaggaggagggtgggtgcagggctggtgggacaaaaagaggcctcagcaggcctggaagacccttccagtacatcccacagcgtgtcgagcagctgggagaacctgtgtcaagctcgagccgtcataggtccccatgaggtgtctgaagccccttcttggtgatgggaggcagaggtgctgacgttctggagcatggacgtgagtcctcagctggctccgcgtgggcccttggagggtgccaggtgtgtggtgaccttctggatgcctttaacttcatggctgcgtcattcctgatttagaactttaaccggagcttcatctagtgattgcaaaactggaccaatgggaggacggcggcgcagcccgctccctccgtggaatggagctcagctcttcggaggcatcaaagcacctgtcgcctccgtggtccccctgctgagggagtgcggcctctgcaaggttcgggggtggcttcgtttgcctggagtggccggccctgcttgtgccatgtggatgtttgtgagcctcggtcctacagcactgtgtaggctgcatctgtttcgtgctggtcctgttgacttgtatgatatccacaaataaatattttcatggcggtcgtgttga

SEQ ID NO: 25059 - DNA, 7297 bp, Homo sapiens
cggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacagtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctgccttgatttcagccacacccctgcagccctgcatcccagctctggggtgtgcagaggtttgtgtctccagggaacccacggctggagagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttcttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcctgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgtaaggatgaattccacaataggatcctttttaaaatcgattttaaattgttgcctagtcctgccaaggttattatgtgcatctgttatttttccaatacatgtaaacagttgcagcatgatgctttgtttaatgtcctgttcttaagctcgttagagccagttttgaaacgtttggtcttaccgtgaacggaggctggcttggcttagccacgctgatgagtaagtgagggatgtctccatcttgagatcaccaggcaagagagttgcctgcaccaggtaagaggccaaagcccctggggtaacagtccccaccgctacccgaggtaaaacaataaaagctatgtggttgagctcaggcctctcgtgcctggtgtcagagaaggcagagcccacagtaggtgcacggtgcaaggccctgggagggcactggccagggaaggtggtatagatggccctcagattgcggggccccgagcagctccccactctgcccgtccaccttccctggctccagcctcattctctctttagtttaactatgcaaagagaggaggttgagagtgttctggcagctggagctcttttccttgtccttcctgccctccgatggggccacctgtgtcggggcagcagtgtccatgtttatggagatcagaggtgtccccactgtgtggctggactgtactctgctgcccgggtagccaggagtctctccctctctcccctgccgcctgcctggtctcatgggcctccttcacacacccctccctgtggatcgcctgcctgggcccagagcaggggaactggagtttgtgagtgagcagagcaggttatgtgcagacagggaaacgagaactttggacctggctttctgagtccaggtgagagctgtgtggccccccgatgccactctgcccgccggagggatgtgcctgctgagccttttccttccacgccgcctctcactgccaggccagcggcttccgctgagactcgctggagaggcggctcccgtgtccgtccaccgagcactcagatggatgctgatcaccagggccgagggggctcccagaaggaccccaggccctggggagggtggctgtgggaggccaagtccactgcccggaagtcttgtcagccctaagccagggaagcctggagcgtggcctggcgggtctgggtggacaccgtccccactccggactcccagcacaggggaggatacctgagcctgtatggccctgtagccctgggcagagctgggcctgtcgtgtgttcctgcctggcaggtgcaggtgctggccatctgcaggtggaaggaggtgggaatcttggattttttgtttttttttgtttttttttttttgaggtgaagtctcgctctgacacccaggctggcgtgcagtggtgtgatctcggctcactgcaaactccgcttcctgggttcaagtggttctcctgccccagcctcccaagtagctgggattacaggcatgcgccaccacgctcagctgatttttgtatttttagtagagatggggtttcaccatgttggccaagctggtctcaaactcctgacctcaagtgatctgcccgcctcggcctcccagagtgctgggattacaggcatgagccagtgcacccggcggaatcttggaatttttatagacagcacctcagtttctgactccagccgcacacctcctgcctctgccagcaggggttgccgccagaccagagccagggccaggtccctgcgtccatcccccccggtaggatggacgtgagccatccttctaggggacttttttcagtgtgcgactcgtctctgttaggtggtaggagccagtttgtgtggcctgtgccacgctccacagtgcgtggctgggctctgtgtgtggcctgtgtcccctgtccctgcaggacccagcaggcatcgtggcgtgacagctgtgtccaagccactgcccgggcatcccatcacccaccagggtgcacggtctctcctgctgggggctttctgtcgcatgtgtgtctcctgtcgactctgcagtttgttctcagagcagaatgtttcctgttctcagtgcacaaagacactggttttcaatcggcgtctaaaaccacgttcctgcctttcattgcaacacggtgtgttcatttgtttaaaacagtttaatgagtaagtttagatgactggtcaatatcttaaaaatgtatattagtaagaagttcttcctggaatttttctttcgattctggcagaataaacaggtgtttttagttttcccactgtctgagccaagcaggaccctgtcccagagcaagagatgtccccttccatctctgacccttgcctgggacaagctttgatggggggccccagcttcaaggctgtggtgggaacagcacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcggataggtgggtgggaacagagaggggagaatgccgtcctaagcttctgcttggggatcccccacacgacctgggtactgcctgggaaacctgtcctaagtaaaactatggacctcgcctcgcccaccggcctgcgaagccagcatctccgtgaaggtggatggaagcgcctttgtcctcattttgagctgcaagctgggtcagcggctctgaagccctcgagtgactttctaacccaagacccagcccctggcaggaggagggtgggtgcagggctggtgggacaaaaagaggcctcagcaggcctggaagacccttccagtacatcccacagcgtgtcgagcagctgggagaacctgtgtcaagctcgagccgtcataggtccccatgaggtgtctgaagccccttcttggtgatgggaggcagaggtgctgacgttctggagcatggacgtgagtcctcagctggctccgcgtgggcccttggagggtgccaggtgtgtggtgaccttctggatgcctttaacttcatggctgcgtcattcctgatttagaactttaaccggagcttcatctagtgattgcaaaactggaccaatgggaggacggcggcgcagcccgctccctccgtggaatggagctcagctcttcggaggcatcaaagcacctgtcgcctccgtggtccccctgctgagggagtgcggcctctgcaaggttcgggggtggcttcgtttgcctggagtggccggccctgcttgtgccatgtggatgtttgtgagcctcggtcctacagcactgtgtaggctgcatctgtttcgtgctggtcctgttgacttgtatgatatccacaaataaatattttcatggcggtcgtgttga

SEQ ID NO: 25060 - DNA, 2812 bp, Homo sapiens
attctcgagggatgccggcgggaggtgaggcgggagacttggaagcctgggcccggaagtgagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacaga

SEQ ID NO: 25061 - DNA, 3875 bp, Homo sapiens
cgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgtt

SEQ ID NO: 25062 - DNA, 2533 bp, Homo sapiens
atttccagcctttcactccatgaatagtactttgtgattattatacttctaccttgatgattgcaacaggctgctggaaagagtttggtgaacaatccaccgggcatcctccccccttcacctgcgcacgttagggagggccggcgtggcgcccagacggactctcaccctgtcgcccaggctggagtgcaatggcgccatctcggttcactgcaacctccgcctcccgggttcaaacgattctcctgcctcagcctcctgagtagctggggttacaggcacaccaccacgcccagatagcagaccccacgttagctgaaatgggaaaaaacttgaaggaggcagtgaagatgctggaggacagtcagagaagaacagaagaggaaaatggaaagaagctcatatccggagatattccaggcccactccagggcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactggga

SEQ ID NO: 25063 - DNA, 2683 bp, Homo sapiens
gaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaacagaagaggaaaatggaaagaagctcatatccggagatattccaggcccactccagggcagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatga

SEQ ID NO: 25064 - DNA, 2058 bp, Homo sapiens
ttaagcagcacacttagaagaatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcaggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctgggtgagaatggcagtcacccccctttcctttcaggtccccgtccatcaccatccgacctgctggtgagggtgacgcgtgctcgtgtatgggaactgaggcccacaggaggagccgccctgccagtgctgggcctgctctggagttctgttccccattgcgttaccacctcacgagctgggtcacctctggcaagtccttctggcattgctccctcactttccttgctgctgtataaggctgtgagacaacaggcaaaaggtgggctgcagggcagctgcggtgggttctggtgagcctgggcagcacagccgggagccccaggcagagtctgccgagcatctgcagctggcagtgtggagccaggcctgcactttgatagcgttttgggcactgaatagcagctctaggatttgagtctgaagggtcttgtgaacagtgtgggatggcggcagcagcagttctagccaatgctggacacgcccagcctagcagggttggcagataagtcctggtacatccatgctggggctcagcacagctgtgagagaccacagagctgagtgtctcaagcagaaaggaactggtcataaacgaaatgaatcaatgcaggttactaagcagtgtcaagtagcatgttttatgacaacaactacaactccctgcccgccactaggagaaaagacgctgggggcagaccacatgtcagcagtgggtgtcgcttagtaatatattgtgggtcattgttattttcttctttttgtttacttgtatttcctaaatttttctacaatgaacttgtattaataagaaaaaaccataaaatttactgttttt

SEQ ID NO: 25065 - DNA, 2047 bp, Homo sapiens
ccccgccccgccgcctctcaaccatcaggttcggcagcccgcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagacc

SEQ ID NO: 25066 - DNA, 1819 bp, Homo sapiens
gaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccaggtaatgaacctggcagcttctcttttcaagtaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataatt

SEQ ID NO: 25067 - DNA, 3464 bp, Homo sapiens
cattggctccgaggacttaggacctgttagcttggttgggcgactggcaaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggcatttgaggagactcatctgacctcccttgacccagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaactggagagatccagaaccttgggagtcattaaagccaagtcattcatagcagccaggaaacaataggaaccaaaagcctctgcctgctgctattgcaattcccaggatctctccttccctggatccctccctcccaggtctgggctgtgcagttcctccccctgccttaaaacaccccactatctctgtaaagtctctctctctcttttttttttttttacttaatctagctagaatctatttctgttgattacaacttaactaactcatttacggataggacttttttttttctttttttcttttttcttttcttttttttttttgagatggagtctcactctgtcacccaggctggagtgcagtggtgtgatcttggctcactgcaacctctgcctcccaggttcaagcaattctcctgcctcagcctcccaagtagctgggactacaggcacacgccaccacacccaactaatttttgtatttttagtagagatggggtttcaccatgttggccaggattgtctccatctcttgaccttgtgatccacccacctcagcctcccaaagtgctgggattacaggcatgagccaccacacccagcgagacggggtttcattatgttggccaggctggtctccaactcctgacctaaagtgatctgcccgccttggcctcccaaagtgctgggattacagacatgagccaccacgcttggccgggatagtatatttttatagcacttcccctactgattgctgccttctctgtggctacaagggacccacagaattacagggaagttacagggaagcaggtttcatctcaatattgggagagatttcaaacaatcacacctgcctgagaaggagtgggctgtcactaggaatttttattcccagtccgtcaggaattttgtagaagggcttcatgtgctggtaccaataggacaggaagattttaatcagctttactatctatgtttttttatggaaactgtgtgtatgtatacatacattttccaaaaagaaaaattaaatgattatagagattatgtttttcagactactcacgtatctgcttttcttactccccacctctgctgataattcctagttcattggtttttcccccacactggaattacctggggagcttaaaaaaccctgatgcctgggtcccaccctcagagatgattgaaccagcctggccagcatggcaaaaccctgtctctactatgatatgaatgcagcctgggcactgggaaatttaaaaactccccagataattctgtgcagccaaggttgagacctcctagtctagagctttgctatacacagggtggtccacaagccaggagcatcagcatcacttggcagcgccttagagattcagaccccagacccactgaatctgaccctgcattttcactagaccccaggtgatcagctgcactagactcaacctctaaaccaagacctcccaccctcacagtctatgatcctttagtgaccctcagctgagtcctgtgctgaactgtgtttgttctccttgagcacatgcccgctaaccagggacagactggatgagcaagcaacctgctggctatggagaagagccaggctgggtaaatgtttgctgtgactaagccaggatcaaagaactgcctgttgcttgcactggctggcactgagcttgccactctgtgaactgtgcttccttcccctgcatggacctgtgcctcagtcactattatccgcaggccttctccaagggcagccctctccttgtttatccctcttaagcctgcgtgcaggaaggcacattaaccctgtggccccctgcaggcaggagggtgttgggtgcccttacctaccttgccctttttcttgtaccgtaggctgtgccgtttatgagtaagtgatgtgtgtctgtgtgtgtgtctagaagtgctgcactcaccttgtgttattggaggttgtgtaaccccctagctttgagcctggtctcagatgttccttttccgttctctgtccagccgttaccgcccccagtctgtaataaaagcctatcagccgtgcacttt

SEQ ID NO: 25068 - DNA, 1210 bp, Homo sapiens
aaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggcatttgaggagactcatctgacctcccttgacccagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaactggagagat

SEQ ID NO: 25069 - DNA, 1152 bp, Homo sapiens
aaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaact

SEQ ID NO: 25070 - DNA, 1196 bp, Homo sapiens
aaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggcatttgaggagactcatctgacctcccttgacccagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatact

SEQ ID NO: 25071 - DNA, 1639 bp, Homo sapiens
aagggagcttgggtaggggccaggctagcctgagtgcacccagatgcgcttctgtcagctctccctagtgcttcaaccactgctctccctgctctactttttttgctccagctcagggatgggggtgggcagggaaatcctgccaccctcacttctccccttcccatctccaggggggccatggccagtacagagtcctccctgttgagatccctaggcctcagcccaggtcctggcagcagtgaggtggagctggactgttggtttgatgaggatttcaagttcatcctgctgcctgtgagctatgcagttgtctttgtgctgggcttgggccttaacgccccaaccctatggctcttcatcttccgcctccgaccctgggatgcaacggccacctacatgttccacctggcattgtcagacaccttgtatgtgctgtcgctgcccaccctcatctactattatgcagcccacaaccactggccctttggcactgagatctgcaagttcgtccgctttcttttctattggaacctctactgcagtgtccttttcctcacctgcatcagcgtgcaccgctacctgggcatctgccacccacttcgggcactacgctggggccgccctcgcctcgcaggccttctctgcctggcagtttggttggtcgtagccggctgcctcgtgcccaacctgttctttgtcacaaccagcaacaaagggaccaccgtcctgtgccatgacaccactcggcctgaagagtttgaccactatgtgcacttcagctcggcggtcatggggctgctctttggcgtgccctgcctggtcactcttgtttgctatggactcatggctcgtcgcctgtatcagcccttgccaggctctgcacagtcgtcttctcgcctccgctctctccgcaccatagctgtggtgctgactgtctttgctgtctgcttcgtgcctttccacatcacccgcaccatttactacctggccaggctgttggaagctgactgccgagtactgaacattgtcaacgtggtctataaagtgactcggcccctggccagtgccaacagctgcctggatcctgtgctctacttgctcactggggacaaatatcgacgtcagctccgtcagctctgtggtggtggcaagccccagccccgcacggctgcctcttccctggcactagtgtccctgcctgaggatagcagctgcaggtgggcggccaccccccaggacagtagctgctctactcctagggcagatagattgtaacacgggaagccgggaagtgagagaaaaggggatgagtgcagggcagaggtgagggaacccaatagtgatacctggtaaggtgcttcttcctcttttccaggctctggagagaagccctcaccctgagggttgcagggaggcagggatatcatgggtgacctcatctctcataaccccttcagttgccgactctttttagccaatgccaatcttctactcctttctcgttgtttctgttccttcctggggccattggtcctacaatcttcctgaaaatcttccccagtcctctttccctgtcccatttcccccacagcctcctatagcatgtgtttctctacccagaccagagcattcagct

SEQ ID NO: 25072 - DNA, 1700 bp, Homo sapiens
tctgggttccagggacgctggggccggagctgctgccgccgtctacacggtcccctcatttgacgggttcgcctcctagcagcgcctgggcgagtgacatctgggccggaccagctggtgctgcgcggcgcaggtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtca

SEQ ID NO: 25073 - DNA, 2398 bp, Homo sapiens
gtcagcattggtgtaaaggactggagcttcagggttctcgggattcgagtcctggccctgctgcttgccagctctgtgctgtggcaagttacttcctctccccaggtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtcatcaaggggtatgctccatgctttgagtcaccaatgaagcgggtgagggaagatgagagggggaggtgagagcttctgggaaggggcatttgagctgggttttgagggatgattatgagctctctggagaggagtgatattccatttatttagaaagcctttactgacaccttgtgctcaggcctgtgttggttctggggccctagaagaaccagtcctagccctggtccatacgggctcccaactgctggaagtacagactggcacagcaacatcagggttgtgacagagggaagcatggctggggggagggggtacacagacagtgcccatgacccagtccaaggagtcaggaaagagctctctgaggagggagcatctgagccagatgttgagggctgagtgggaacttggcaagcagaagtggggagcactttaatgcaacccaggtatgctccatgcatatccagctgggccagcctcgtgctgggctctgccctgggcagacaggcagagggccagagcagaggacacatggccttgcgtgtgtgaaagctgagaaaatgggagctgtgcttcagctaccctccagacaagggcaagagttagccagatgctccaggcagtgggaagccaatggagggattaagcggcggaagcttcttagaagaggcagggggcgaagtgcagtggctcatgcctgtaatctcagcaatttgggaggccaaggaaggaggaatgcttgagcccaagagttttagaccagcctgggcaacacagtaagaccctgtttctacaaaaaaatataaaaaa

SEQ ID NO: 25074 - DNA, 1829 bp, Homo sapiens
aaggacagaggaggggcccttcctgtcagctggctgggagcagaggtggctttgtcttttcggaagaactggttctgtggaatttgtgcttatttcccatcaaggatcaaggacctgctctggggctacctcagggccccacaggatgaggggctggttttcagatgagttttctgcttgcctgtcatctggatagtgtctaaaaatttgcaaactgccttcttgtcagtgtcttgctcattcttcatgacactcctgatatgtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtca

SEQ ID NO: 25075 - DNA, 1515 bp, Homo sapiens
gccggagctgctgccgccgtctacacggtcccctcatttgacgggttcgcctcctagcagcgcctgggcgagtgacatctgggccggaccagctggtgctgcgcggcgcagataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactg

SEQ ID NO: 25076 - DNA, 800 bp, Homo sapiens
ccagtggctcctgtgaccacatcgaccaggcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctg

SEQ ID NO: 25077 - DNA, 1425 bp, Homo sapiens
gaaacagaggaagctgctcactctgtcagagaagttgcagcctagctgagggcaggagagtggggagcctcaggtctggcttccctttgccccaacacacttgggaccaccagcgtgctgcagggacaggaggctgcctcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaag

SEQ ID NO: 25078 - DNA, 2351 bp, Homo sapiens
accggtggtcagagtgaaacagaacagaacgggaggtttcacaatgtccttccatacaatctctggaatctatagataacaacagctgctaggtcaggggtcgaattttaactaccaggcttaggtcaggcaggcccaggcctggtttcgggtctggttccttggtttcgggtctggttccttggtttcaggtctggtttttaggcgccgggctacctgcctttagtttcgcttctctttccttttccgagtataaaacagtatgagagggtctctctcctccctcagtgccatcctcatccctgggtgggagttgtctggatccatagggttggagccacagataacagagccattaatctcggggtctcagcctctcttaacggaccttccaggcactgctgagaaaaccaggttaatggtttcctgcggcagcaatgagcagaagcagggccatctccagactccagagaagccaggagagggctggggtgataatggggaggaggataaaaaacagccacccaatgcgtgccttccctgtgccaggcccttgtcctgaaatgttatctcactccatcctcccaacagtcccttgggctaaattggtgatgctgcttgtttgagtgagcaaacagagggtgaatgaagtgacttgcgggcagctgggtagaggatgagtcagcattggtgtaaaggactggagcttcagggttctcgggattcgagtcctggccctgctgcttgccagctctgtgctgtggcaagttacttcctctccccaggtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtc

SEQ ID NO: 25079 - DNA, 1611 bp, Homo sapiens
tgctctggctcctctgggttccagggacgctggggccggagctgctgccgccgtctacacggtcccctcatttgacgggttcgcctcctagcagcgcctgggcgagtgacatctgggccggaccagctggtgctgcgcggcgcaggtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtg

SEQ ID NO: 25080 - DNA, 1674 bp, Homo sapiens
tggctcctctgggttccagggacgctggggccggagctgctgccgccgtctacacggtcccctcatttgacgggttcgcctcctagcagcgcctgggcgagtgacatctgggccggaccagctggtgctgcgcggcgcagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtca

SEQ ID NO: 25081 - DNA, 741 bp, Homo sapiens
cgggagggcttgggagagtgaaagctcacccggatctgggtggagaaagtatgacaggtcccaggctcaccctctcacacatacaaacacatgcacatacaagagaagctgctccgaaatctcatttttttatcttccaaaattcctgtggattttgcattcttctataatatttctgcatataaaaacactgttctgataaattaccatccaatgagttggctcaagtcttggagataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatct

SEQ ID NO: 25082 - DNA, 1662 bp, Homo sapiens
agcactagtcaagtgactctaagaagggccattttcccttgttgtctttgaaaatacttcattttcttagcatttcaggagattataacatcctgtatttcagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagttgcaaataaaattgaatccattccagtcaaaggaataatcccatctaaaaagacgaaacagaaagaagtgtatcctgctacacctgcatgcaccccaagcaaccgtctcacagctaaaggagcagaggagactcttggacctcagaaaagaaaaaaaccatctgaagaagagactggaaccaaaaggagtaagatgtccaaagagcagactcggccttcctgctctgcaggagccagcacgtccacagccatgggccgttccccacctccccagacctcatcatcagctccacccaacacttcctcaactgaggcatatttgatgaacttgacattatctctgactgcaggaagttttctgtcctgtgctgtttggggaagagacagagaactgcggaatctggaactttcagcaacagactcactgtctactgcccccatctattatacacccattccctttgctcactaatttgttcaagtttctctgacatacaccatgctcctttttcctttaggattttcacacaccatatttctttcacctttaaactcttacctggccaaccctatccaccctctggatcccaatattgagatcttatcctcagggaatcctcacttagacccctgtaacaggttaaatcttcatggtgttctgtttcctaggaacttctttcttttctactgtttatgacaactgaagttaataagtgtttatctttcccacctactcaaagtagttccaagattagggctagtttgtaattctgtggaccactgtaaacgagggcctagttcagtgtctgcctcatgggaagcttccaataaatacctttgctcaacgaaaaaatgaaaacccagtggctcacgcctgtaatcccagcactttgggaggccgaggcaggtggattgcctgaggtcaggagtttgagactagtctggccaacatggtgaaacactatctctactaaaaatacaaaaaaattagctgggtatggtggcttacgcctataatcccagctactcaggaggctgaggcaggggaattgcttgaaccagggaggtggaggttgcagtgagctgagatcgcaccactgcactccagcctgggtgacagagcgagactccatctcaaaataaaaaagtaaaaaaaaaaaaaaaaaa

SEQ ID NO: 25083 - DNA, 1723 bp, Homo sapiens
gaggaagccagcactagtcaagtgactctaagaagggccattttcccttgttgtctttgaaaatacttcattttcttagcatttcaggagattataacatcctgtatttcagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagtcaaaggaataatcccatctaaaaagacgaaacagaaagaagtgtatcctgctacacctgcatgcaccccaagcaaccgtctcacagctaaaggagcagaggagactcttggacctcagaaaagaaaaaaaccatctgaagaagagactggaaccaaaaggagtaagatgtccaaagagcagactcggccttcctgctctgcaggagccagcacgtccacagccatgggccgttccccacctccccagacctcatcatcagctccacccaacacttcctcaactgagagcctaaaaccattggccaaccgtcacgcaactgccagtaaaaatattttccgagaagacccaataatcgcgatggtactaaatgcaacaaaagtatttaaatatgaatcctcagaaaatgagcaaagaagaatgtttcatgctacagtggctacgcagacacagttctttcatgtgaaggttttaaacatcaacttgaagaggaaattcattaaaaagagaatcatcattatatcaaattattccaaacgtaatagtctcctagaggtgaatgaagcctcttctgtatctgaagctggtcctgaccaaacgtttgaggttccaaaggacatcatcagaagagcaaagaaaattccgaagatcaatattcttcacaaacaaacttcaggatatattgtatatggattatttatgctacatacgaaaattgtaaataggaagacgacaatctatgaaattcaggataaaacaggaagtatggctgtagtaggaaaaggagaatgccacaatatcccctgtgaaaaaggagataagcttcgactcttctgctttcgactgagaaagagggaaaatatgtcaaaactgatgtcagaaatgcatagtttcatccagatacagaaaaatacaaaccagagaagccatgactccaggagcatggcactaccccaggaacagagtcagcatccaaaaccttcagaggccagcacaaccctacctgaaagccatctcaagactcctcagatgccaccaacaaccccatccagcagttccttcaccaagaaggatgaaacccacccaggagcacagtcatcgcctgcaaactttagaatcacctcaccaactgtggcccctcctctttcttctgacacttccaccaaccgccatccagcagttccttaaataaggtcaccaaggacaaggatatcaaataac

SEQ ID NO: 25084 - DNA, 2083 bp, Homo sapiens
agagtatgaggaagccagcactagtcaagtgactctaagaagggccattttcccttgttgtctttgaaaatacttcattttcttagcatttcaggagattataacatcctgtatttcagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagttgcaaataaaattgaatccattccagtcaaaggaataatcccatctaaaaagacgaaacagaaagaagtgtatcctgctacacctgcatgcaccccaagcaaccgtctcacagctaaaggagcagaggagactcttggacctcagaaaagaaaaaaaccatctgaagaagagactggaaccaaaaggagtaagatgtccaaagagcagactcggccttcctgctctgcaggagccagcacgtccacagccatgggccgttccccacctccccagacctcatcatcagctccacccaacacttcctcaactgagagcctaaaaccattggccaaccgtcacgcaactgccagtaaaaatattttccgagaagacccaataatcgcgatggtactaaatgcaacaaaagtatttaaatatgaatcctcagaaaatgagcaaagaagaatgtttcatgctacagtggctacgcagacacagttctttcatgtgaaggttttaaacatcaacttgaagaggaaattcattaaaaagagaatcatcattatatcaaattattccaaacgtaatagtctcctagaggtgaatgaagcctcttctgtatctgaagctggtcctgaccaaacgtttgaggttccaaaggacatcatcagaagagcaaagaaaattccgaagatcaatattcttcacaaacaaacttcaggatatattgtatatggattatttatgctacatacgaaaattgtaaataggaagacgacaatctatgaaattcaggataaaacaggaagtatggctgtagtaggaaaaggagaatgccacaatatcccctgtgaaaaaggagataagcttcgactcttctgctttcgactgagaaagagggaaaatatgtcaaaactgatgtcagaaatgcatagtttcatccagatacagaaaaatacaaaccagagaagccatgactccaggagcatggcactaccccaggaacagagtcagcatccaaaaccttcagaggccagcacaaccctacctgaaagccatctcaagactcctcagatgccaccaacaaccccatccagcagttccttcaccaagaaggatgaaacccacccaggagcacagtcatcgcctgcaaactttagaatcacctcaccaactgtggcccctcctctttcttctgacacttccaccaaccgccatccagcagttccttaaataaggtcaccaaggacaaggatatcaaataactactgttcaatctttactcaagtgtggaaattttgcctgaagtcctccacctaaaaacctgatgccattggtaatgatgtttatgaagataagatcaaagcacagaaaataatatatgtatatatatctggttgaaatactatatatatatatatatatatatatatatatatatatatatatatataccagctattaattctaggaaatggagtattaagggtgcattttatttcattagttttacttttatgcattttcttcatatcatattttgcattcagaattttcataatttgaaaaaaaataaacttttttttcttaaa

SEQ ID NO: 25085 - DNA, 1597 bp, Homo sapiens
aggaagccagcactagtcaagtgactctaagaagggccattttcccttgttgtctttgaaaatacttcattttcttagcatttcaggagattataacatcctgtatttcagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagtcaaaggaataatcccatctaaaaagacgaaacagaaagaagtgtatcctgctacacctgcatgcaccccaagcaaccgtctcacagctaaaggagcagaggagactcttggacctcagaaaagaaaaaaaccatctgaagaagagactggaaccaaaaggagtaagatgtccaaagagcagactcggccttcctgctctgcaggagccagcacgtccacagccatgggccgttccccacctccccagacctcatcatcagctccacccaacacttcctcaactgagagcctaaaaccattggccaaccgtcacgcaactgccagtaaaaatattttccgagaagacccaataatcgcgatggtactaaatgcaacaaaagtatttaaatatgaatcctcagaaaatgagcaaagaagaatgtttcatgctacagtggctacgcagacacagttctttcatgtgaaggttttaaacatcaacttgaagaggaaattcattaaaaagagaatcatcattatatcaaattattccaaacgtaatagtctcctagaggtgaatgaagcctcttctgtatctgaagctggtcctgaccaaacgtttgaggttccaaaggacatcatcagaagagcaaagaaaattccgaagatcaatattcttcacaaacaaacttcaggatatattgtatatggattatttatgctacatacgaaaattgtaaataggaagacgacaatctatgaaattcaggataaaacaggaagtatggctgtagtaggaaaaggagaatgccacaatatcccctgtgaaaaaggagataagcttcgactcttctgctttcgactgagaaagagggaaaatatgtcaaaactgatgtcagaaatgcatagtttcatccagatacagaaaaatacaaaccagagaagccatgactccaggagcatggcactaccccaggaacagagtcagcatccaaaaccttcagaggccagcacaaccctacctgaaagccatctcaagactcctcagatgccaccaacaaccccatccagcagttccttcaccaaggtcaccaaggacaaggatatcaaataac

SEQ ID NO: 25086 - DNA, 1624 bp, Homo sapiens
aggaagccagcactagtcaagtgactctaagaagggccattttcccttgttgtctttgaaaatacttcattttcttagcatttcaggagattataacatcctgtatttcagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagttgcaaataaaattgaatccattccagtcaaaggaataatcccatctaaaaagacgaaacagaaagaagtgtatcctgctacacctgcatgcaccccaagcaaccgtctcacagctaaaggagcagaggagactcttggacctcagaaaagaaaaaaaccatctgaagaagagactggaaccaaaaggagtaagatgtccaaagagcagactcggccttcctgctctgcaggagccagcacgtccacagccatgggccgttccccacctccccagacctcatcatcagctccacccaacacttcctcaactgagagcctaaaaccattggccaaccgtcacgcaactgccagtaaaaatattttccgagaagacccaataatcgcgatggtactaaatgcaacaaaagtatttaaatatgaatcctcagaaaatgagcaaagaagaatgtttcatgctacagtggctacgcagacacagttctttcatgtgaaggttttaaacatcaacttgaagaggaaattcattaaaaagagaatcatcattatatcaaattattccaaacgtaatagtctcctagaggtgaatgaagcctcttctgtatctgaagctggtcctgaccaaacgtttgaggttccaaaggacatcatcagaagagcaaagaaaattccgaagatcaatattcttcacaaacaaacttcaggatatattgtatatggattatttatgctacatacgaaaattgtaaataggaagacgacaatctatgaaattcaggataaaacaggaagtatggctgtagtaggaaaaggagaatgccacaatatcccctgtgaaaaaggagataagcttcgactcttctgctttcgactgagaaagagggaaaatatgtcaaaactgatgtcagaaatgcatagtttcatccagatacagaaaaatacaaaccagagaagccatgactccaggagcatggcactaccccaggaacagagtcagcatccaaaaccttcagaggccagcacaaccctacctgaaagccatctcaagactcctcagatgccaccaacaaccccatccagcagttccttcaccaaggtcaccaaggacaaggatatcaaataac

SEQ ID NO: 25087 - DNA, 771 bp, Homo sapiens
gacacccactgcccttaacagaaaaaatactgctgagcaaagggtttaacaggactctcggtctaccagaagttcagtgcattttccaggattttcaaggcttcgatgctgtcatgttgtgagcccactatccacttgtgtttttccatgaataatgaaggaaacctgaggaatcatgaatgtaatcattgagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagttgcaaataaaattgaatccattccagtcaaaggaataatcccatctaaaaagacgaaacagaaagaagtgtatcctgctacacctgcatgcaccccaagcaaccgtctcacagctaaaggagcagaggagactcttggacctcagaaaagaaaaaaaccatctgaagaagagactggaaccaaaag

SEQ ID NO: 25088 - DNA, 1409 bp, Homo sapiens
gagaggctgcagcggcagcagctgtcgcgccagtcgcaacagaagcaggtccgaggcacagcccgatcccgccatggagcagccgaggaaggcggtggtagtgacgggagctagaaaagctaggccttggcgacagcgtggacctgcatgtgtacgagattccggttgagtaccaaacagtccagagactcatccccgccctgtgggagaagcacagtccacagctggtggtgcatgtgggggtgtcaggcatggcgaccacagtcacactggagaaatgtggacacaacaagggctacaaggggctggacaactgccgcttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcagatatctctgcgactttacctactacacctctttgtaccagagtcacggtcgatcagccttcgtccacgtgcccccactggggaagccgtacaacgcggaccagctgggcagggcactgagagccatcattgaggagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttcagcttggggatccgatctggaagagagattctgatctgcccacctcctcttcctccttctctacaaaagctccggttgattcgagggaagtggtgaaaatttttttttctcccattttcctccctgcatctggggacacagctgccgtgaccagggaggccagcctgggaggtccagatgcccagggagaatcttggtctggtgaatccatgagctgcgataccacggctggggccatatgttcacctgctttcctgtccgttggtgaaggaatttcagaattcattttatatccaagactggcttttaccaaatttaaaagcctctcaatgcgtcctcgaccttgaactgtgctcaacagcctggccctttctggggccaccctgggatatggctggctggctggctttctttctttctttctttctttctttcttgctttctttctttcttgctttctttcttctctctctctctttttttttttttttaaatagtgctagtttgggcacagagtaatttatattccctttggttaaaatgcaggctttttagccaacaacaaaagtgttttccccccacccccactcgcccaccagggtgatgccacttttgcctcctgccctgaaaattggacttaagatgccatgtcttggccaggcgca

SEQ ID NO: 25089 - DNA, 7084 bp, Homo sapiens
ctcgcgcggccgagaggctgcagcggcagcagctgtcgcgccagtcgcaacagaagcaggtccgaggcacagcccgatcccgccatggagcagccgaggaaggcggtggtagtgacgggatttggcccttttggggaacacaccgtgaacgccagttggattgcagttcaggagctagaaaagctaggccttggcgacagcgtggacctgcatgtgtacgagattccggttgagtaccaaacagtccagagactcatccccgccctgtgggagaagcacagtccacagctggtggtgcatgtgggggtgtcaggcatggcgaccacagtcacactggagaaatgtggacacaacaagggctacaaggggctggacaactgccgcttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcagatatctctgcgactttacctactacacctctttgtaccagagtcacggtcgatcagccttcgtccacgtgcccccactggggaagccgtacaacgcggaccagctgggcagggcactgagagccatcattgaggagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttcagcttggggatccgatctggaagagagattctgatctgcccacctcctcttcctccttctctacaaaagctccggttgattcgagggaagtggtgaaaatttttttttctcccattttcctccctgcatctggggacacagctgccgtgaccagggaggccagcctgggaggtccagatgcccagggagaatcttggtctggtgaatccatgagctgcgataccacggctggggccatatgttcacctgctttcctgtccgttggtgaaggaatttcagaattcattttatatccaagactggcttttaccaaatttaaaagcctctcaatgcgtcctcgaccttgaactgtgctcaacagcctggccctttctggggccaccctgggatatggctggctggctggctttctttctttctttctttctttctttcttgctttctttctttcttgctttctttcttctctctctctctttttttttttttttaaatagtgctagtttgggcacagagtaatttatattccctttggttaaaatgcaggctttttagccaacaacaaaagtgttttccccccacccccactcgcccaccagggtgatgccacttttgcctcctgccctgaaaattggacttaagatgccatgtcttggccaggcgcagtggctcatgcctgtaatcccagcactttggaaggccagggtgggcggatcacctgagatcaggagttcaagatcagcctggccaacatggtgaaaccctgcctctactaaaaatacaaaaattagccgggcatggtgatgagtgcctgtagtcccagctactcgggaggctgaggctggagaatcgcttgaacttgggaggcagaggttgcagtgagctgagattgcacagctgcactccagcctgggtgacagagcgagactctgtctcaaaacaattggacttaagatggcatgtctttgttttagggccaaaaatgaggcccccttgcttaaggcatggggtccgtggccaggcaacggggtgggactgctgccccagatgtggccatgggggtcgtggtcctttcaacaccaagctatgagctgtcgccatggagaccagggccacctgtggaaaggcggattttgtctgcttttgacttttcttttttaatatgtaaaactccacatcagcggaaacccccccctacttctggcctggagcttcagggttttggtgctgggacgagtttgttgttctccttagcggggtggcgcggggggctcaaaacgggggcgcgggggctggagttggcagagctctgcatgtcccggcatgtctgagcaggaggaattccgggcggccaaagggttttatgtagattgcttttggacactcgcccaggagtcaggagttgatttttatctcacttcctggtaaccttgaacttaccaggcagggatgagatgacgtaaacttcctcagatgatgtaagttcagccacatcttgctgcccattagggagagaggacgacccccacagtgaaagtaattgagtgaaatgcacgttctggaaatcagtttctattttggcctggaggaatgtggctatactgcttccctgagtgtgacacagttggaatctaatcttgttggtttcccaacatctaggtttttgtttgtttgtttgtttttatgatagggtcttgttctgttgaccaggctggagtacagtagtgtgatcatggatcactgcagcctctacctcctgggctcaagtgatcctcccatctcagcctcctgagtagctgggactacaggcatgcaccaccacacctggctaatttttaaattttttatacagacagggtttcaccatgttgcccaggctggtctcgaactcctggactcaaactgatcctcctttctcggcctcccaaagtgctgggattacaggcatgagccactgcacccagcccagttctttcttaaaacagctgagagttttgttttcttcagcgttcaccttccttgtctccagttccgatgctggcagtggttcctacctctgttgggtttctagatagtttgggaacggggttgatgggtttctgtgaaacacattttccaagtcttgggctttctctggaggggaaggtggatgctggcgggtgacttgcagtgggcgcctggcagtgggtgtggactgtaactgacaggtggaaatgagtagggacactattgttccctccatgccagcttttttttttgctggaaatgccccctccacacccctggtagctctgtgtcctgagaaatccagagtgtgggagacatcactgcatctgtccccccagcttctgtgaagggaagctgtggcctcttttgaatgtggggaacaactgaagactcaggggtcacccagaggtctggtggaaagcaacttcaggtttcatcttgctctattcctcaaaggtctggtctgtgggcctctgaggagaaaacaggtctagccaagacagggacaaaatggggaaggggatgtgccaggcctgaactgagctaagcacctgccccgggctccacacttccatctttcttttgtcttcatttcacctctgtgtttaaagcactgtgtgacatagctccttagagatataacctattgtctgctcattgtcacgtgtgtgtgtgtcatctttgtattcttgcagtggtttcacatttccttacccagtcaagccagtatcccatccttcctcataatgcacaacatttggctcattttatttttctcattgttattttttatttttattttttgagatggattctcacactgttactcgggctagagtgcaatggcgtgatctcggctcactgcaacctccacctcctgggtttacacaattctcctgcctcagcctcccgagtagctgggattacaggcgcccgtcaccacacctggctaatttttgtatttttagtagagatgcagcttcaccatgttggccaggctggtcttgaaatcctgacctcaggtgatctgcctgccttggcctcccaaagtgctgggattacaggtgtgagctactgcgcctggccaagttttttacaaatatttttcttttggtggaactcatctgtgcactctctggtgtgtttttccacctttgttgggtcttggcttaaaatatcctcatgtgggctaggtgtggttactcacacctgtaatcctagcactttgggaggttgaggcaggagaatcccttgagccaggagttcaagaccagcctgggcaacatagcaagagatcccatatctaccaaaacatacaagaattagccagatgtggtggtgcatgcctgtggtcccagatactcaggaggctgaggcaggaggatcacctatgcctgggaggttgaagccccagtgagccatgatcacaccactgtagtccagcccgggtgacacagcaagactctgtctcaaaaaaaaaaaaaaaaaaaatcctcatgcaagaagggaaggaccaagtcccattccctcttgcctcattttcagagcctggggtaggggctacaggtggcataggaagggtctgcaaggtgggtgggacttggcaggtgttgggaagaggaataggggtggcaagtgtcaatggtgaaaagacaggctgaggggtgtggtgggaaggctgggggagaaaggtgagaagtgattgggggggcttccctgatgagtcctcatggagggtgctgaggcagggaacaggggtgcagggacagtgatcagggcacctggtaccctgaccaacttgatgatggcatctcttttaagatgcccaagtctgcgcacttttattcctttattcggcccctagcaccccctccccaccccaaagaaggtcagttgcatgcgtgtggggatgtagctcaaaaaagaaataagatggagtggaaaggaaagaaaggaagaagcaggaattcaaggtgggtgggctgagcttggggccacctagcccacctgctccaatcaagggctggaacaaacctgaggccacttggagaggcagggctgggcagggacagggggtgggggccgaaatcacagcttccccatcagagccagatgtgtgaaggaaatgtcccagatggcagtagtttctcggcaaggaggggaatcctggagatggttcatgtctgtgatcccagtgctttgggaggctgaggtgggaggattgcttgagcccgggagttcgagaccagccctgggcaacatggcgagaccccatctctacagaaattaaaaaaaaaaattagccagttgtggtgtcaagcacctgtagtcccagctacttgggaggctgagttgggaggcttatctgagcccaggaggtgaaggctgcaatgagccatgattacactactgtaccccagcctgggcaacagagcaagaccctgcctcaaaattaagaaaaaaaaaaggggggccaggcgcagtggcttatgcctgttatcccagcactttgggaggccaaggcagactgatcgcttgaggccaggagtttgcgaccagcctggccaacatagcaaaaccccatctctactaaaaatacaaaaattagtcaagagtggatggtgcgtgcctgtaatcccagctacctgggaggctgagacaggagaattgcttgaacctgggaggcagaggttgcagtggtgtgagatcacgccactgcattccagactgggcaacatagcaagactctgtcacaaaaaaaaaaaaaaaaaagaattccctgctctgcttttctgctcgttgctggcatagaaacatctagaacagaaagtatccactctggggcagatgggagagctggaaaagtagattcaagatgccttttagtcttggaagtttcttccaggaagcaagaccagctggtatgtttacacctgcactccagtgccctggggaggtgaccaggtggagggggatggctcatggaaatctgtcccgcacagctggcccccttttggctgccactgtctagactgttggcctttgacctctctgcctcttgtggcgtctgaacctagacgtcccttttggagacagctggacaaagccctattctccgcagccccagcctctatcctgaggcctctgggagctgcgtgacggccagcatggggtgctgatcatggtcaaggaggcaggtctttgccaggttgccccatgcagccacccatcctcagcatcctaacttgagggggcaggagagggctttgtttttataatccggattaaatttcccttccctgggcacaagtgcctcatgagggcccggggctgctggttgggagggaaagcatccccgtttttgcagtgaggaggccggccgagggctggggttccacttagacccttggcagaatggctgttgaggggcaggcgctgcccagtgcccacgtctggaaagctaattcccgggtggacgctgaacatacctgctgagagactctgtcccctggtttccaggacagttgtcacaagctgagtggggggggactcccaggacttgagggacccagtcccaccccaaactgctccccctcccccaaattccctttctcctcctgctctttctccccgctgtgcctcccccagttacccacagaagtgcctgcctctccagcgctcacagaacacacaaaaagggacaggaattggtcactgggtagtggccgtggctcctgacgatccagaccagcgtctggcccaagccattcagaggtggggtctggggcctgggggttttgtgtcgtgacactttgtctcaaggagattccacatagggatttgaattaggctttctgcttgccaaggcctgtggcatctgagcctggctgagggccgggcaagcctcccctgagcctttggaagccgagttcactctctgcctgcccaggggagcaccggcttggttctgggggctcctctaacatctcaggtttttatcttgtcttaaatttctttctaggaaaaaacccttccctgccaaaggtgactgtgttttctgccgccgaaggagggcccggtccctccaggctcagtgtggcttctccctgacccccgccctagaacttttgccagtgccttttctgaaactcctgtgtcccgggccccccaggcggagaaggatatgccggattctgcctggggctgggctctaggagaccccaaatttgacaccacagaaagcaaataaaacacttgaaatacgcatac

SEQ ID NO: 25090 - DNA, 839 bp, Homo sapiens
accagtgcagggaccgggtcgcgccgtgctatggccctgtaccacactgaggagcgcggccagccctgctcgcagaattaccgcctcttctttagaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatggtctcagaaatattccagtatatacaataaatcgcatagtcatcctgccttcacttgacaggagccaaacttccagcctgtcctacctgcctgcacatcaggattcctgtgtgcccctggatgcagccctacatgttgttttgtatttttgttccctcttgggtctacaaagttacttatcttgtttttgagtctttttgatgttaatctgtttataaggtatctattttaggtaggttagcctgagggagtacattgaaacacgaatttagtgcccctcctgtcaaaaggtctctgttttttccgaagcag

SEQ ID NO: 25091 - DNA, 1684 bp, Homo sapiens
ccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaattactctcctttggacatttattgatataaaaagaagattttggccaggcacggtggctcatgcctgtaatttcagcactttgggaggccgaggtgggcagatcacaaggtcaggagttcaagaccagcctggccagtatgttgaaaccccatctctattaaaaatacaaaaattagccaggcgtggtggtgcatgcctgtagacccagctactcaggaggctgaggcagaagaactgcttgagcccaggaggcagaggttgcagtgagcagagattgtgccactgcactccagcctaggcgacagagagagactccgtctcaaaaaaaaaaaaaagattttgtttcatttcatagcacaaatttagaggcattgagttgaccatttctagtttctatacctgaaggaacccattgattttaccagtttttatttctgtagattggatgtaaaaatcacagattcaataaattaataaactttgtgta

SEQ ID NO: 25092 - DNA, 1414 bp, Homo sapiens
ccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaattactctcctttggacatttattgatataaaaagaagattttggccaggcacggtggctcatgcctgtaatttcagcactttgggaggccgaggtgggcagatcacaaggtcaggagttcaagaccagcctggccagtatgttgaaaccccatctctattaaaaatacaaaaattagccaggcgtggtggtgcatgcctgtagacccagctactcaggaggctgaggcagaagaactgcttgagcccaggaggcagaggttgcagtgagcagagattgtgccactgcactccagcctaggcgacagagagagactccgtctc

SEQ ID NO: 25093 - DNA, 667 bp, Homo sapiens
atgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 25094 - DNA, 1221 bp, Homo sapiens
ccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggacactgaggctcaaggcatttttatagacttgtctaagatctgggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaatttt

SEQ ID NO: 25095 - DNA, 1122 bp, Homo sapiens
ccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaatttt

SEQ ID NO: 25096 - DNA, 859 bp, Homo sapiens
atgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 25097 - DNA, 2059 bp, Homo sapiens
agtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcaccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatct

SEQ ID NO: 25098 - DNA, 1716 bp, Homo sapiens
agtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatct

SEQ ID NO: 25099 - DNA, 1346 bp, Homo sapiens
agctgggttggggtcgggctccgggaatggtgggcggcggtcgccgggtggggcgcgacgagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcaccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagccc

SEQ ID NO: 25100 - DNA, 1717 bp, Homo sapiens
agtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctggggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatct

SEQ ID NO: 25101 - DNA, 1411 bp, Homo sapiens
gcgtggcggccgcagcgctgagggagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatctccattgagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacggtgggcccccgcgctgcccgcttccctggtctccagtccttgcatggcagaggcctctctcacacacatctgctcattcacgcactcagcagatacgtattgagctccagcccagtgttgcgcaggacacagggggccccgaggttccctgggttactgtgggcagtgcccctccccaccttccgtttcctgcgaggagggaacatccatagagggacccggatgctgtgccctgtgctccccacataggttcaccattgtcatagctaggagtgtcatttgagccaggggccacaccagtggggtggcggggtggccagccacattaggaaacttctgtgggggcccaccttcctcctgccctcgctgtgggattaagttagaccagtaggacacgcagcaacatccaggcacaaggaaaattccatggaaggtgaaagaagcaaagagcaagagaaagacagagtttgctgtttgcctgggatcccacagctggtcaaaggcagagccaggctgggagccgctgtccccagttcaggtctgcagggtgggtgaggacgtctttctcgccacactgcccactctccagtccagacaccctcagactctgcgagtgccaccctgtaacagtgaggggaacacgaggggcctggcctcacctccagcctgcaggggagacaggtgtaaacccacatcccgtggtggggccacgagaactca

SEQ ID NO: 25102 - DNA, 1714 bp, Homo sapiens
gtcagtggaggcagcagcggtagaggcggcggcgaggactggcgacggcgaggagatagtgtctgccttctggagagctgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaaggtcagaagacaccaggcacagcccttggccgcagccctgggccgcccctgtggacaggaagccaggaggccccaggctgctgtgactgcccccaccggccctggtagccccacccttgtccgtgtgccaccagcggcccgtgtcctgtcctcccgtctcgggggacctagccagacaacaccagagactagcactgaggtgtccccaacaattttattataaataaaaacaagactcccagtgggtggctgc

SEQ ID NO: 25103 - DNA, 4004 bp, Homo sapiens
caggcagcaggcctcaggcccagacttgggtgttacaggaacagtgtggcctctctggaactctgcagaccaactgccgtgatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgccctccatgctgga

SEQ ID NO: 25104 - DNA, 4005 bp, Homo sapiens
gtcagtggaggcagcagcggtagaggcggcggcgaggactggcgacggcgaggagatagtgtctgccttctggagagctgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgcc

SEQ ID NO: 25105 - DNA, 4192 bp, Homo sapiens
gtcagtggaggcagcagcggtagaggcggcggcgaggactggcgacggcgaggagctgccttctagtctcacctgtggacactttgccaaaggagtcgggcctgacggtggaagatgggaaatggccaaaagaataaaccatttcctcttacttaccgaatgaaaagcttgcttcatcttggcgttcaagactctctaatatgattccacctgttgggctctttcttccatttgcctccgcagatagtgtctgccttctggagagctgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgc

SEQ ID NO: 25106 - DNA, 699 bp, Homo sapiens
gctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcagtttctccttcctctaacacaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatgg

SEQ ID NO: 25107 - DNA, 709 bp, Homo sapiens
gaaacattggagagtttcattctcatacaggagcaggtcatgtgaaagtaaaatggtttggggcagttggattcatgcttcgcccctcccctgtttattaccaggtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtg

SEQ ID NO: 25108 - DNA, 734 bp, Homo sapiens
gacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtagtcaaggacgaggattgtgtgctgctttagatttggccctggactttgtcttcaaaaactttcacagccccagacaacttttcctgaagtagtacagccatgtgctgcacagtgacgctttggtcaatgtcgcatatatgatgttggaccc

SEQ ID NO: 25109 - DNA, 3484 bp, Homo sapiens
agcgcatgacgttattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccgagacatggtcttgctacgttgcccagtctggtctccatctccaggctcaagcagtcctcccacctcggcctcccaaagtgctgggattactctcactctcttaaaaccaggcaggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctgggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatg

SEQ ID NO: 25110 - DNA, 1527 bp, Homo sapiens
gaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccgtttgcagggtccccccccccccgccaccttacagtaggaagaaaattgagttccagatatgaagtcacctttgaaagtgcccaggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgctt

SEQ ID NO: 25111 - DNA, 471 bp, Homo sapiens
gcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccgtttgcagggtccccccccccccgccaccttacagtaggaagaaaattgagttccagatatgaagtcacctttgaaagtgcccaggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttg

SEQ ID NO: 25112 - DNA, 3310 bp, Homo sapiens
actgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctgggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaa

SEQ ID NO: 25113 - DNA, 731 bp, Homo sapiens
gccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccgagacatggtcttgctacgttgcccagtctggtctccatctccaggctcaagcagtcctcccacctcggcctcccaaagtgctgggattactctcactctcttaaaaccaggcaggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtg

SEQ ID NO: 25114 - DNA, 3277 bp, Homo sapiens
agcgcatgacgttattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctgggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatg

SEQ ID NO: 25115 - DNA, 129 bp, Homo sapiens
gccaatcagtggatcaagtttaagtcagttaaggggaggagaaggagaggttataccttcagggggctaccagacagtgttctcaacttggttaaggaggaagaaaacccagtcaatgaaattcaatga

SEQ ID NO: 25116 - DNA, 3391 bp, Homo sapiens
agcgcatgacgttattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcagtttctccttcctctaacacaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctgggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatg

SEQ ID NO: 25117 - DNA, 1387 bp, Homo sapiens
aggccaggccttccggcggtcgttacgggacgccgctgccatctacagcactccgtgaagaatatgctggccgccttcatctcccgcgtgttgaggcgagttgcccagaaatcagctcgcagagtgctggtggcatcccgtaactcctcaaatgacgctacatttgaaattaagaaatgtgatctttatctgttggaagagggtccccctgtcactacagtgctcactagggcggaggggcttaaatactacaggatgatgctgactgttcgccgcatggaattgaaggcagatcagctgtacaaacagaaattcattcgcggtttctgtcacctgtgcgatggtcaggaagcttgttgcgtgggccttgaggccggcataaacccctcggatcacgtcattacatcctatagggctcatggtgtgtgctatactcggggactttctgtccgatccattctcgcagagctgacgggaagaagaggaggttgtgctaaaggaaaaggaggatcgatgcatatgtataccaagaacttctatgggggcaatggcatcgtcggtgcacagggccccctgggcgctggcattgctctggcctgtaaatataaaggaaacgatgagatctgtttgactttatatggggatggcgctgcgaatcaggggcagatagccgaagctttcaatatggcagctttatggaaattaccttgtgttttcatctgtgagaataacctatatggaatgggaacatctactgagagagcagcagccagccctgattactacaagaggggcaattttatccctgggctaaaggtcgatggaatggatgttctgtgtgttcgtgaggcaacaaaatttgcagctaactactgtagatctggaaaggggcccatactgatggagctgcaaacctaccgttatcatggacacagtatgagtgatcctggagtcagttatcgtacacgagaagaaattcaggaagtaagaagtaagagggatcctataataattctccaagatagaatggtaaacagcaagctcgccactgtggaagaattaaaggaaattggggctgaggtgaggaaagaaattgatgatgctgcccagtttgctaccactgatcctgagccacatttggaagaattaggccatcacatctacagcagtgattcatcttttgaagttcgtggtgcaaatccatggatcaagtttaagtccgtcagttaaagggaggctacgtgtgaatttatcatcagtctctcaatggaatgttcatggtcaaatttaagaaactgtgttctcaactcaaggaggaataaaactcataaaacaaaagccttgtaagcatttattaaaagagattattaaaagagattgaaagaca

SEQ ID NO: 25118 - DNA, 1527 bp, Homo sapiens
cccctctgttgtcgtttggcagcggatagaggacacgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagagggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctcatgaaagatgtatccaaacaagataacttatatgtataaaattaaagcatataatatacatttactgttagtttgttttgataaggaataaaggaatttctaacatga

SEQ ID NO: 25119 - DNA, 1478 bp, Homo sapiens
gccggcccctctgttgtcgtttggcagcggatagaggacacgaccaagatggcggcggtgtctggcttggtgcggagaccccttcgggaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagagggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctcatgaaagatgtatccaaacaagataacttatatgtataaaattaaagcatataatatacatttactgttagtttgttttgataaggaataaaggaatttctaacatga

SEQ ID NO: 25120 - DNA, 1397 bp, Homo sapiens
acgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctcatgaaagatgtatccaaacaagataacttatatgtataaaattaaagcatataatatacatttact

SEQ ID NO: 25121 - DNA, 3576 bp, Homo sapiens
actgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgcaaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtatttttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctctaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaa

SEQ ID NO: 25122 - DNA, 3491 bp, Homo sapiens
aagacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgcaaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtatttttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctctaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgat

SEQ ID NO: 25123 - DNA, 4272 bp, Homo sapiens
actcgtcactgcgcagccaatcggcaggcgggaagcactccggcccgaacgtgcgggcggggcagggtggcggccccgcacggtaggggagcagagtgggcaggccgggggtgagggctcgcgctccgggagctgcacggggctgcgtggaaagagcgccgagcggtggcgtcgttgtcgccccctcctcgtcgggaagaatcgtttggtctcctgccgtgcccggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgcaggttgtgcttgttcccaggcagtcagtgaaagactcttttattatattgctgtctctttgttaccccatgagactttgctagagattgaaaatgcagtggagagcggccgggcactgctacccattctccagtggcacaagcaccccaatgattactttagtaaggaggcatccaaattgtactttaacagcttgaggacttactggcaagagcttatagacctcaacactggtgagtcgactgatattgatgttaaggaggctctaattaatgccttcaagaggcttgataatgacatctccttggaggcgcaagttggtgatcctaattcttttctcaactacctggtgcttcgagtggcattttctggagccactgcttgtgtggcccatgtggatggtgttgaccttcatgtggccaatactggcgatagcagagccatgctgggtgtgcaggaagaggacggctcatggtcagcagtcacgctgtctaatgaccacaatgctcaaaatgaaagagaactagaacggctgaaattggaacatccaaagagtgaggccaagagtgtcgtgaaacaggatcggctgcttggcttgctgatgccatttagggcatttggagatgtaaagttcaaatggagcattgaccttcaaaagagagtgatagaatctggcccagaccagttgaatgacaatgaatataccaagtttattcctcctaattatcacacacctccttatctcactgctgagccagaggtaacttaccaccgattaaggccacaggataagtttctggtgttggctactgatgggttgtgggagactatgcataggcaggatgtggttaggattgtgggtgagtacctaactggcatgcatcaccaacagccaatagctgttggtggctacaaggtgactctgggacagatgcatggccttttaacagaaaggagaaccaaaatgtcctcggtatttgaggatcagaacgcagcaacccatctcattcgccacgctgtgggcaacaacgagtttgggactgttgatcatgagcgcctctctaaaatgcttagtcttcctgaagagcttgctcgaatgtacagagatgacattacaatcattgtagttcagttcaattctcatgttgtaggggcgtatcaaaaccaagaatagtgagtggctctttcactggcaattctcaaatgatatacatttaaagggcagattttttaaaaagatactactataataaacatttccagttggtcattctaagcatttacccttttgatactctagctagtcaggtactccaaattgactttgcagcagggtggcagggtcaggagagtctggtcctgcctagctcagatttcatggcacctgcacttgaagcaagtcacttctttatcacaggtgtcttgaaacattagcttcttttaccaacctgagaaaattaggatgacctggcaaataagatcttgaataggccaaaagcaagtatcttgctgtgtgtagtctcttggttaaagtgaagaaacagtactgttcacacctttcttcactgagattccagtgtacatgagaacatatatttattgcatgattttctagatacacagtctatgcattattcatatacatttattttagcctaaagtggttttcaaatccagttcttcaagccataaatgaccaagatccaagcaatctgaatttgtttttgtgattatttgactggaatgcttcttaagtggaataactatactccgttatccacccgatttcctaatgtaattgaaagattttctattttgccacacacttggagacaataagggtttttagttttatctactcttctattgaagttaaagaaagaaaaaaagatttttttatttgtattaatgaaaagctttagtttaaaataaggagatccagaataaaaagaagagactgatctcttcaattattgtcatctgtagccaccagcacatcactcttatgtaatccccaaaggcttggcatgccgtaagtgtgtggtgggtagactgctgccggggaatcgtacttcttatttagtaatgataagacttttcattatttttggaattttaaagatgacataaataagtttaaatatcaatttggggagtaaggtttaatattgccatcgggtattgagacaggaggaagtttctgtttttctccatttagacataggtcaattaaaatatttgggtttaaaatgactaaatgctttaaacatattgtagcttaagatatatgtgttaagatatatacatgagaaactttaaaaggtaactactgtgcatgcctgatgcttaatagaatacttagtggcatcaaatgtttgcagcagtctccataattatattcagtcccttctaatactgtatcaatgtaaatgaaataaatatattcaaattggctttttgatatgcatcaagtggcattttgttcctgtgtttaatagtgatctgtatacagctgtgcacatattgtcatcacttattctagcatcactgttaaggctgtgattatgtttgatattcacctggattttaatacaagccaatatcagcttcccattgtgtaataacttgggtgtttaggagtcttttcacattttttggggatatgaactagatgttcaagaactccttctggactgtggatactgaatcagtgtactattggctgcagaatttgtttcaattgaaaatagactcaggaagattgctgctcagaatatcatataatgtttattttttgaggtgtttttgtttttatttgtgtgtttttttttttttaagtcagcttggaacttttttcctgggtagtatttgggagagggaaaggctgtactatatatttatttctaaatgttttgactgggcatttttcttttaatgaaatatgtggactgctctagcaaaccctattttcagctactatttgaatattcttgaacaccaccactgaagagtttcatatacaccaaataatgtctcatctctatagtacagggaatataaaattggtttcctgtggtcatgatcaagatagtagtattattacacaagaaacttggtctgcagtctggaagcttgtctgctctatagaaatgaaaatgcagcatgaagttgacattgtggaaatgaaagtaattgggtattagaaatctgaaagtactgtcatctaaaagcaattgtgattttattgtaattggttgtcactgttgtacggtgtctagaattaaagaatacatgtaaactttcatggtatttagcctttcttaaatttttttaaaatttaaactttctaacctatgtattcaacttctgtatttatatttaatcagtggttcatgttatataatacacccttaactagttaaatggaatgttggtatggtacagagtaccatattgctaagaaaactgtcttataaaagatgtatatgtgtgaagacatgaaagtttaatgtacagaatggttggagaaatgcctatggtgaattaaagcttcatatctgctt

SEQ ID NO: 25124 - DNA, 4358 bp, Homo sapiens
agagtgggcaggccgggggtgagggctcgcgctccgggagctgcacggggctgcgtggaaagagcgccgagcggtggcgtcgttgtcgccccctcctcgtcgggaagaatcgtttggtctcctgccgtgcccggttcgtattccctactccctgccacgagccgccccgtccgggatcctccacccgtccaaagttgtgagggggcgccgggcgtgctcgcggatcggcggccgcgggcgtgcggagggctggacgagccctggagcgccaggagaatgtgtgtgtgtcccgggcccagacgaattggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgcaggttgtgcttgttcccaggcagtcagtgaaagactcttttattatattgctgtctctttgttaccccatgagactttgctagagattgaaaatgcagtggagagcggccgggcactgctacccattctccagtggcacaagcaccccaatgattactttagtaaggaggcatccaaattgtactttaacagcttgaggacttactggcaagagcttatagacctcaacactggtgagtcgactgatattgatgttaaggaggctctaattaatgccttcaagaggcttgataatgacatctccttggaggcgcaagttggtgatcctaattcttttctcaactacctggtgcttcgagtggcattttctggagccactgcttgtgtggcccatgtggatggtgttgaccttcatgtggccaatactggcgatagcagagccatgctgggtgtgcaggaagaggacggctcatggtcagcagtcacgctgtctaatgaccacaatgctcaaaatgaaagagaactagaacggctgaaattggaacatccaaagagtgaggccaagagtgtcgtgaaacaggatcggctgcttggcttgctgatgccatttagggcatttggagatgtaaagttcaaatggagcattgaccttcaaaagagagtgatagaatctggcccagaccagttgaatgacaatgaatataccaagtttattcctcctaattatcacacacctccttatctcactgctgagccagaggtaacttaccaccgattaaggccacaggataagtttctggtgttggctactgatgggttgtgggagactatgcataggcaggatgtggttaggattgtgggtgagtacctaactggcatgcatcaccaacagccaatagctgttggtggctacaaggtgactctgggacagatgcatggccttttaacagaaaggagaaccaaaatgtcctcggtatttgaggatcagaacgcagcaacccatctcattcgccacgctgtgggcaacaacgagtttgggactgttgatcatgagcgcctctctaaaatgcttagtcttcctgaagagcttgctcgaatgtacagagatgacattacaatcattgtagttcagttcaattctcatgttgtaggggcgtatcaaaaccaagaatagtgagtggctctttcactggcaattctcaaatgatatacatttaaagggcagattttttaaaaagatactactataataaacatttccagttggtcattctaagcatttacccttttgatactctagctagtcaggtactccaaattgactttgcagcagggtggcagggtcaggagagtctggtcctgcctagctcagatttcatggcacctgcacttgaagcaagtcacttctttatcacaggtgtcttgaaacattagcttcttttaccaacctgagaaaattaggatgacctggcaaataagatcttgaataggccaaaagcaagtatcttgctgtgtgtagtctcttggttaaagtgaagaaacagtactgttcacacctttcttcactgagattccagtgtacatgagaacatatatttattgcatgattttctagatacacagtctatgcattattcatatacatttattttagcctaaagtggttttcaaatccagttcttcaagccataaatgaccaagatccaagcaatctgaatttgtttttgtgattatttgactggaatgcttcttaagtggaataactatactccgttatccacccgatttcctaatgtaattgaaagattttctattttgccacacacttggagacaataagggtttttagttttatctactcttctattgaagttaaagaaagaaaaaaagatttttttatttgtattaatgaaaagctttagtttaaaataaggagatccagaataaaaagaagagactgatctcttcaattattgtcatctgtagccaccagcacatcactcttatgtaatccccaaaggcttggcatgccgtaagtgtgtggtgggtagactgctgccggggaatcgtacttcttatttagtaatgataagacttttcattatttttggaattttaaagatgacataaataagtttaaatatcaatttggggagtaaggtttaatattgccatcgggtattgagacaggaggaagtttctgtttttctccatttagacataggtcaattaaaatatttgggtttaaaatgactaaatgctttaaacatattgtagcttaagatatatgtgttaagatatatacatgagaaactttaaaaggtaactactgtgcatgcctgatgcttaatagaatacttagtggcatcaaatgtttgcagcagtctccataattatattcagtcccttctaatactgtatcaatgtaaatgaaataaatatattcaaattggctttttgatatgcatcaagtggcattttgttcctgtgtttaatagtgatctgtatacagctgtgcacatattgtcatcacttattctagcatcactgttaaggctgtgattatgtttgatattcacctggattttaatacaagccaatatcagcttcccattgtgtaataacttgggtgtttaggagtcttttcacattttttggggatatgaactagatgttcaagaactccttctggactgtggatactgaatcagtgtactattggctgcagaatttgtttcaattgaaaatagactcaggaagattgctgctcagaatatcatataatgtttattttttgaggtgtttttgtttttatttgtgtgtttttttttttttaagtcagcttggaacttttttcctgggtagtatttgggagagggaaaggctgtactatatatttatttctaaatgttttgactgggcatttttcttttaatgaaatatgtggactgctctagcaaaccctattttcagctactatttgaatattcttgaacaccaccactgaagagtttcatatacaccaaataatgtctcatctctatagtacagggaatataaaattggtttcctgtggtcatgatcaagatagtagtattattacacaagaaacttggtctgcagtctggaagcttgtctgctctatagaaatgaaaatgcagcatgaagttgacattgtggaaatgaaagtaattgggtattagaaatctgaaagtactgtcatctaaaagcaattgtgattttattgtaattggttgtcactgttgtacggtgtctagaattaaagaatacatgtaaactttcatggtatttagcctttcttaaatttttttaaaatttaaactttctaacctatgtattcaacttctgtatttatatttaatcagtggttcatgttatataatacacccttaactagttaaatggaatgttggtatggtacagagtaccatattgctaagaaaactgtcttataaaagatgtatatgtgtgaagacatgaaagtttaatgtacagaatggttggagaaatgcctatggtgaattaaagcttcatatctgctttctg

SEQ ID NO: 25125 - DNA, 2140 bp, Homo sapiens
attcaccgggctggagcgagacctcgcccctcctccgctcccgcctccccgccgccgcctcctctaatgagcatctctgccttgctttcaatgggccggtgctgctgtcgctgctgctgcccgcgcgggttgtggatgttgtcggctccgtgttgtgatgacaggagaatgtgtgtgtgtcccgggcccagacgaattggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgcaggttgtgcttgttcccaggcagtcagtgaaagactcttttattatattgctgtctctttgttaccccatgagactttgctagagattgaaaatgcagtggagagcggccgggcactgctacccattctccagtggcacaagcaccccaatgattactttagtaaggaggcatccaaattgtactttaacagcttgaggacttactggcaagagcttatagacctcaacactggtgagtcgactgatattgatgttaaggaggctctaattaatgccttcaagaggcttgataatgacatctccttggaggcgcaagttggtgatcctaattcttttctcaactacctggtgcttcgagtggcattttctggagccactgcttgtgtggcccatgtggatggtgttgaccttcatgtggccaatactggcgatagcagagccatgctgggtgtgcaggaagaggacggctcatggtcagcagtcacgctgtctaatgaccacaatgctcaaaatgaaagagaactagaacggctgaaattggaacatccaaagagtgaggccaagagtgtcgtgaaacaggatcggctgcttggcttgctgatgccatttagggcatttggagatgtaaagttcaaatggagcattgaccttcaaaagagagtgatagaatctggcccagaccagttgaatgacaatgaatataccaagtttattcctcctaattatcacacacctccttatctcactgctgagccagaggtaacttaccaccgattaaggccacaggataagtttctggtgttggctactgatgggttgtgggagactatgcataggcaggatgtggttaggattgtgggtgagtacctaactggcatgcatcaccaacagccaatagctgttggtggctacaaggtgactctgggacagatgcatggccttttaacagaaaggagaaccaaaatgtcctcggtatttgaggatcagaacgcagcaacccatctcattcgccacgctgtgggcaacaacgagtttgggactgttgatcatgagcgcctctctaaaatgcttagtcttcctgaagagcttgctcgaatgtacagagatgacattacaatcattgtagttcagttcaattctcatgttgtaggggcgtatcaaaaccaagaatagtgagtggctctttcactggcaattctcaaatgatatacatttaaagggcagattttttaaaaagatactactataataaacatttccagttggtcattctaagcatttacccttttgatactctagctagtcaggtactccaaattgactttgcagcagggtggcagggtcaggagagtctggtcctgcctagctcagatttcatggcacctgcacttgaagcaagtcacttctttatcacaggtgtcttgaaacattagcttcttttaccaacctgagaaaa

SEQ ID NO: 25126 - DNA, 581 bp, Homo sapiens
agagtgggcaggccgggggtgagggctcgcgctccgggagctgcacggggctgcgtggaaagagcgccgagcggtggcgtcgttgtcgccccctcctcgtcgggaagaatcgtttggtctcctgccgtgcccggttcgtattccctactccctgccacgagccgccccgtccgggatcctccacccgtccaaagttgtgagggggcgccgggcgtgctcgcggatcggcggccgcgggcgtgcggagggctggacgagccctggagcgccaggagaatgtgtgtgtgtcccgggcccagacgaattggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaa

SEQ ID NO: 25127 - DNA, 596 bp, Homo sapiens
aagaatcgtttggtctcctgccgtgcccggttcgtattccctactccctgccacgagccgccccgtccgggatcctccacccgtccaaagttgtgagggggcgccgggcgtgctcgcggatcggcggccgcgggcgtgcggagggctggacgagccctggagcgccaggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagt

SEQ ID NO: 25128 - DNA, 1284 bp, Homo sapiens
atagaacgctcattaattacagcacagttttcataaattccaacttccctaggaattttgtcttttgaaggcatgttggaagttggggcattaggatataatctcagtccatgtactaagcctctgcataactgaaagatagagtcaataaaattcactctctcattttttgtttttaatctcaagaatttttgccttgaaggaaaaatgtagtggagaatttgatgtttgaacgttagaagagtgagactcaaagatgtgagctgacttttccaagattatttgggagttggtggcagacctatgcccgttagcctggcaaattgccacagtggactagagaagcaagttttgcaagaccatctactgggctttccccagccaaatctgttgtacattctgcacagtttgtactgcacaaaggacgacaaagaaaagagaaaattgaagtttgagtataggagccaggagttcagtcgtggttccacgaatgattgggagttgtgcctgccagaatataccctgtagaaatagtacatgatgaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgcaggttgtgcttgttcccaggcagtcagtgaaagactcttttattatattgctgtctctttgttaccccatgagactttgctagagattgaaaatgcagtggagagcggccgggcactgctacccattctccagtggcacaagcaccccaatgattactttagtaaggaggcatccaaattgtactttaacagcttgaggacttactggcaagagcttatagacctcaacactggtgagtcgactgatattgatgttaa

SEQ ID NO: 25129 - DNA, 341 bp, Homo sapiens
ctcgtcactgcgcagccaatcggcaggcgggaagcactccggcccgaacgtgcgggcggggcagggtggcggccccgcacggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgct

SEQ ID NO: 25130 - DNA, 2554 bp, Homo sapiens
acggtaggggagcagagtgggcaggccgggggtgagggctcgcgctccgggagctgcacggggctgcgtggaaagagcgccgagcggtggcgtcgttgtcgccccctcctcgtcgggaagaatcgtttggtctcctgccgtgcccggagaatgtgtgtgtgtcccgggcccagacgaattggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgcaggttgtgcttgttcccaggcagtcagtgaaagactcttttattatattgctgtctctttgttaccccatgagactttgctagagattgaaaatgcagtggagagcggccgggcactgctacccattctccagtggcacaagcaccccaatgattactttagtaaggaggcatccaaattgtactttaacagcttgaggacttactggcaagagcttatagacctcaacactggtgagtcgactgatattgatgttaaggaggctctaattaatgccttcaagaggcttgataatgacatctccttggaggcgcaagttggtgatcctaattcttttctcaactacctggtgcttcgagtggcattttctggagccactgcttgtgtggcccatgtggatggtgttgaccttcatgtggccaatactggcgatagcagagccatgctgggtgtgcaggaagaggacggctcatggtcagcagtcacgctgtctaatgaccacaatgctcaaaatgaaagagaactagaacggctgaaattggaacatccaaagagtgaggccaagagtgtcgtgaaacaggatcggctgcttggcttgctgatgccatttagggcatttggagatgtaaagttcaaatggagcattgaccttcaaaagagagtgatagaatctggcccagaccagttgaatgacaatgaatataccaagtttattcctcctaattatcacacacctccttatctcactgctgagccagaggtaacttaccaccgattaaggccacaggataagtttctggtgttggctactgatgggttgtgggagactatgcataggcaggatgtggttaggattgtgggtgagtacctaactggcatgcatcaccaacagccaatagctgttggtggctacaaggtgactctgggacagatgcatggccttttaacagaaaggagaaccaaaatgtcctcggtatttgaggatcagaacgcagcaacccatctcattcgccacgctgtgggcaacaacgagtttgggactgttgatcatgagcgcctctctaaaatgcttagtcttcctgaagagcttgctcgaatgtacagagatgacattacaatcattgtagttcagttcaattctcatgttgtaggggcgtatcaaaaccaagaatagtgagtggctctttcactggcaattctcaaatgatatacatttaaagggcagattttttaaaaagatactactataataaacatttccagttggtcattctaagcatttacccttttgatactctagctagtcaggtactccaaattgactttgcagcagggtggcagggtcaggagagtctggtcctgcctagctcagatttcatggcacctgcacttgaagcaagtcacttctttatcacaggtgtcttgaaacattagcttcttttaccaacctgagaaaattaggatgacctggcaaataagatcttgaataggccaaaagcaagtatcttgctgtgtgtagtctcttggttaaagtgaagaaacagtactgttcacacctttcttcactgagattccagtgtacatgagaacatatatttattgcatgattttctagatacacagtctatgcattattcatatacatttattttagcctaaagtggttttcaaatccagttcttcaagccataaatgaccaagatccaagcaatctgaatttgtttttgtgattatttgactggaatgcttcttaagtggaataactatactccgttatccacccgatttcctaatgtaattgaaagattttctattttgccacacacttggagacaataagggtttttagttttatctactcttctattgaagttaaagaaagaaaaaaa

SEQ ID NO: 25131 - DNA, 544 bp, Homo sapiens
aacatttgagcacatcttctggctcagtcatgtacacttaacctctggatgactttcaggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgca

SEQ ID NO: 25132 - DNA, 1692 bp, Homo sapiens
gacaacccaacagtgtggagcagacccacagagagggagacccagagaggtgtgcagtggcatggaagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgcgggtgctaagcatatcctgagacgcccctccctcctctggcccagcctacccttgtaccccatcccttcctccccagtctacgttctccagcccacacccctccaaagccccacctttaagtcctctcttctctattcctgaccctccctacctga

SEQ ID NO: 25133 - DNA, 2083 bp, Homo sapiens
cattccatggtcccgcagccccaggcccacactgaaagcatgtcgatccaggagaacatatcatccctgcagcttcggtcatgggtctctaagtcccaaagagacttagcaaagtccatcctgattggggctccaggagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgcgggtgctaagcatatcctgagacgcccctccctcctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattccctgcatccaatctgctcagcaggccctaagatgccttgagtctttaatccca

SEQ ID NO: 25134 - DNA, 2479 bp, Homo sapiens
actttaaccagtctgcagaactgatccccagcccagctgggcctcatgcctctgacaacccaacagtgtggagcagacccacagagagggagacccagagaggtgtgcagtggcatggaagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgcgggtgctaagcatatcctgagacgcccctccctcctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattccctgcatccaatctgctcagcaggccctaagatgccttgagtctttaatcccagtttggctggttaattccataaccccaggcatcccatcccttggggtgggggagaggggagacagggcaatcttgtccacagtctcccattctcatatgtagccctcatgataatctgggcatctcgtgccagggcaggctaccccttcatggtgactaacagttacatgaaagtccacgcttttgggaaaactgggtgggatggatgctggggagaagtgagggctgggcagctgattttgtcactgtcttcacaacctccgtgctgggcttgtagaccactgtcctggctgctctcatgcctgcctgataccctgcttggtcaaatccccggctgcttccttctgcacccagaaattccttcccactcatgttgttcccacacacaaaccaagagccaaaaatgagtgtgtc

SEQ ID NO: 25135 - DNA, 3116 bp, Homo sapiens
cattccatggtcccgcagccccaggcccacactgaaagcatgtcgatccaggagaacatatcatccctgcagcttcggtcatgggtctctaagtcccaaagagacttagcaaagtccatcctgattggggctccaggagtgcctctgacaacccaacagtgtggagcagacccacagagagggagacccagagaggtgtgcagtggcatggaagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgcgggtgctaagcatatcctgagacgcccctccctcctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattccctgcatccaatctgctcagcaggccctaagatgccttgagtctttaatcccagtttggctggttaattccataaccccaggcatcccatcccttggggtgggggagaggggagacagggcaatcttgtccacagtctcccattctcatatgtagccctcatgataatctgggcatctcgtgccagggcaggctaccccttcatggtgactaacagttacatgaaagtccacgcttttgggaaaactgggtgggatggatgctggggagaagtgagggctgggcagctgattttgtcactgtcttcacaacctccgtgctgggcttgtagaccactgtcctggctgctctcatgcctgcctgataccctgcttggtcaaatccccggctgcttccttctgcacccagaaattccttcccactcatgttgttcccacacacaaaccaagagccaaaaatgagtgtgtctattttatatttaaacccagctgtttggaagcaattataaaacttctcccacacaccaagaaccccagaactccccacccagaaggaaaggagacttagggtcctggtcccacagtctttaatgctgtagagtaggagaggggacaggcagagtgagggtggtaaaggactactcttgtccctgagaaggcagaggtgctggctggcctgcccttccccaggcttggataccttgggcctttcccttattcctgcaccaacagcaaactcagaaggaaaaaacaaaacaaaactctaaaggtaaacgcggtccttctccctctctcatgtggctcctcctgcccctacctgggagaaggttcaagtattgcgctgatgggtttgggcaaggaccacagaggctggcatggagaggccctgcctcctcctactcctcctgtctccttacctgaaaaggaggggagggatggataaaggaatgggtaaacaaaattaattggtaacacataaagttagtaaatgaataaatacaattaaataaatg

SEQ ID NO: 25136 - DNA, 2674 bp, Homo sapiens
cgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggaggtgagcggtgcaggaggctacgccatcagtccccaccaagggccagtcgcccggctagtgcggaatcccggcgcgccggccggccccgggcacgcaggcagggcggcgcaggatccagggcgtctgggatgcagtggagctcagagagaggagaacggctcctcacgcctggggcctgctcttcagaagtccccagcgccgttccttccagatcaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacc

SEQ ID NO: 25137 - DNA, 1863 bp, Homo sapiens
gcccacttcgcagtccctagttctccctactgccgctccagtgccagagcccctccgaaggcggccaggacctccaaccacgcacaagtctgcagctctccccaactttccgttcagctcagtctccgagggacctcagcagccatgtcgaagccccatagtgaagccgggactgccttcattcagacccagcagctgcacgcagccatggctgacacattcctggagcacatgtgccgcctggacattgattcaccacccatcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagc

SEQ ID NO: 25138 - DNA, 2458 bp, Homo sapiens
cgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacc

SEQ ID NO: 25139 - DNA, 2302 bp, Homo sapiens
gcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagc

SEQ ID NO: 25140 - DNA, 2083 bp, Homo sapiens
gcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagc

SEQ ID NO: 25141 - DNA, 2254 bp, Homo sapiens
gcacagcagctgcacgcgccgtggctccggatctcttcgtctttgcagcgtagcccgagtcggtcagcgccggagctctccagggcacaccgtattcagctctgagcggtctttgctagtgaggccaaggagccaccctgagccaaaaggggagcattatgtcaccggaagcccaaccccagagaaccaaaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattgtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccatttt

SEQ ID NO: 25142 - DNA, 1331 bp, Homo sapiens
ggcccacgtggttccgacagtcaagatggcgggagcagctacccaggcttccctggagtcggccccacggatcatgcggctggtggccgaatgcagccgctccagggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactt

SEQ ID NO: 25143 - DNA, 1502 bp, Homo sapiens
agtcaagatggcgggagcagctacccaggcttccctggagtcggccccacggatcatgcggctggtggccgaatgcagccgctccagggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggcccctggggcttgtgactggggccctgttgcaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttgggtatgttgtggatagggaagccagagccctacctgtgggaagtggattcctggggaccccctaccctgcttggggaggtggcatttgggggaaacggacacaggtctgatctgaggagactaggaagacatggctgtcccttgggggccattctgagggaatatggcccagtctggggcagtgtgagggttgggaggggccctgggaagcccctgaggttctctgccccctcccgtcatggctgcaaccccagctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatagtgtgtctgtgtcttcttgaggaagtggcctgtctgggtccccctcccagtctgagcgtcattgcagt

SEQ ID NO: 25144 - DNA, 4530 bp, Homo sapiens
ccagggtgaaagttcagcgcgccggcggcacttccaacatggcggcggccggggcggcggtggcgcgcagcccgggaatcggagcgggacctgcgctgagagcccggcgctcgcccccgccgcgggccgcacggctgccgcggctgctagtgctgctagcggcggcggcggtggggccgggcgcgggcggtgcggcgcggctgtaccgcgcgggcgaggacgccgtgtgggtgctggacagcggcagcgtgcgcggggccaccgccaacagctcggccgcgtggctcgtgcagttctactcgtcgtggtgtggccactgcatcggctacgcgcccacttggcgggccctggctggggatgtgcgagactgggccagtgccattcgcgtcgcagctctggactgcatggaagagaagaaccaggccgtgtgccatgactacgacatccacttctaccccaccttccggtattttaaagcatttacaaaggagtttacaactggagaaaattttaaaggacctgaccgagagctgcgaacagtcagacagacgatgattgacttcctgcagaaccacacggaaggaagccggccccctgcctgcccgcgcctagaccccattcagcccagtgatgttctttcccttcttgacaaccgtggcagccattacgtggctattgtctttgaaagcaacagctcctaccttggacgggaggtgatcttagacctgatcccgtatgaaagcatcgtggtgacccgagcactggacggggacaaagcatttctggagaaacttggtgtttcttcagtcccttcgtgttacctgatctacccaaatgggtcgcatggattgattaacgtcgtgaagcctctgcgggccttcttttcgtcttatttgaagtcattgccggatgtgaggaaaaaatcgcttcccttgcctgaaaagccacacaaagaagaaaattcagaaatcgtggtttggagagaatttgacaagtcgaagctgtacacggtggacctggagtcagggctacactacctcctgcgggtggagctggcagcccacaagtccctggccggagcagagctgaagacgctcaaggactttgtgactgtcttggccaagctgttccctggacggccgccagtcaagaagctgttggagatgctgcaggagtggctggccagccttcccctggacaggatcccctacaacgccgtgcttgacctggtcaacaacaagatgcggatttctggaatattccttactaatcacataaagtgggttggatgtcaaggaagccgatctgagttgaggggttacccgtgttctctctggaaactgttccacactttgactgttgaagcctcgacccacccagatgcactggttggcacaggctttgaagacgacccccaggctgtgctgcagacaatgaggaggtacgttcacaccttctttgggtgtaaggaatgtggtgagcactttgaggaaatggctaaagaatccatggactcggtgaaaaccccagaccaagccatcctctggctgtggaagaagcataatatggtgaacggccgcctggcaggccatctgagtgaggatccccggtttccaaagcttcagtggcccactccggacctctgcccagcctgccatgaggaaattaagggcctggccagctgggatgaaggccacgtgctcacattcttgaagcagcactatggccgcgacaacctcttagacacgtattccgcagaccagggggattccagtgaaggaggaaccctggccaggggtgaggaagaggagaaaagactcactcccccagaggtgtcccatggagaccgagacacccagagcgtccgtccacctggtgcactgggccccaggcctgcccttccagagagcttgcatcacagcttggacgggaaactccagagtctggatgggcccggggcccacaaggaggtgggcggggccgcacccttcctcggggttgacttctccagcctggacatgagtctctgtgtcgtgctgtacgtggcttcatccctgttcctcatggtgatgtacttcttcttccgggtgaggtccaggcggtggaaggtcaagcaccaccacccggccgtgtgagtgcccgggtgctgccagccacggcggaagctcccttggaggcagccctgccccgtgccacctgcagctttaatatttatgatcagggattttataaacatgcgggcctggtttcacatcggatggcaccttttggcttcaaagtcctggttttacaaacgctcttctaacaagggaagaacacggggtaattttgtggggatatttgcattcctggcgtactcaagtctgttcatgctccttttgcaggtcttacagcaaaaagacttctgtatttttactcttctagatgtgaaaagagggtgcagagtccaggccagatagtcttccccacacactttcatctcgtttcctccactccgccccatcctgcagggccttgtttttgtatttggagaacctcgcccatcccccccgcggctcctggctcccccccactcccctcgctccccctccccccgctccccccacgccccctgctccaggctgccaagtgttttcctttagccgggcggggacagacagagccggaagcgcagtcggcctctgcagcccctccaagcaagtgctccagggactatcctgtgtttgtagctgcttccctagggcaggttcctgagggctctccttgttcctccgggtgttcgacaccagacgtggggatttcaacaggggaggagccaaggaattctgtggctgtgctgcgtttcagaaaataacccccagaggccttgggctgtggacctgggggttggaaggatgggggctcatttaaccctcagaggcagcgcctttgtctgtctatctggtgacaagagagagacaagtaaatgggggccgttgggacggcgggtgcctggagggcagctctgggctcagcgggcagtgcttagagcacaggcccctctgttgggggatggggaggagagcagtctgcccttgggagcgtaggccccagggagacttctaaagccccccctgtcgtctgctcttcacccagcaccacagaggcacctgctgcacacacaagcatctcactcggcccacggagggggccaggcttcctttgcctgaagctgttttgggaagggtctccacacaggcactgatctcccaagcttttgtcatgatgtcttttaccatttgataattttaaacattgtttttaaacccaaaacatttagtggtccgttgcctctgaagatgtaaacaaacaaatacactatttctgggaacatttatattgagattctttgtggctattggtgtgtctcacaggcaaaatttgatttggctaaaataggctcagatgtatttgtgtgcccgtgtgtgtgtgtgtgtgtgtgtgtgtgtgtgtgtgtgtatgagagagagagagactttgacggttgtagatattttttccgctttgcctactttatgttgtataatcatgtgtttactaacaagttgatgacatggatgtattcataagaccatgtaatattgatgtgattgttgtcgcttgagaaaaaaaggcaacagctgattctttcaacaactgtcacagaatggctgggctgagaacgctgcccagggccctgcagctggcgggagaggtgtctggtgggagcggtgtctggtgcgtcagcctgctgcttcgtgtctcactcgagagttgcttctggtttcacactttttaacccctctgtgctttagcagccgtgaccttgccttcattgcttcatccagtgcaggcctgggttattgaagacaccaaagtgtttctcttccagtttgaaaaccaggcaggtttacacgtgggtttcagtgtatttgcctttgaacccttcaaactaaactttagccttttggctggtgttgaatgtctttagctggggtgacctggagtgacctgggacggtgttgtggtttaccgtctccagcttcagcctttccagaaacccttgtggagggcagtgttggctgcaggtttcatcatattgcagtttgaggtcaccactatttggggaacaagcttgcgtcctgctgaggggcaggattttcagcagagcgtcggtggggctgggccgtcgtggaggtggccccaggagtcatatggccatactcagacacaccttgtgtggcctgctcagagctggatgccacctttaggcaatgtttagagtctattttctaaagttttaagtattttaagaggtattgagactaatgaatataatagttcagtaatttaaatgcttatttattttcagtggaaggatttttattaaaaagaagctaattgacatggaaatgtcagtgaaatttcttacctgcaaggaaagtgaacattttgtatttaagtaaactataatgtgcacattttaataaagaaatctgacatttgaaaaaa

SEQ ID NO: 25145 - DNA, 4287 bp, Homo sapiens
ccagggtgaaagttcagcgcgccggcggcacttccaacatggcggcggccggggcggcggtggcgcgcagcccgggaatcggagcgggacctgcgctgagagcccggcgctcgcccccgccgcgggccgcacggctgccgcggctgctagtgctgctagcggcggcggcggtggggccgggcgcgggcggtgcggcgcggctgtaccgcgcgggcgaggacgccgtgtgggtgctggacagcggcagcgtgcgcggggccaccgccaacagctcggccgcgtggctcgtgcagttctactcgtcgtggtgtggccactgcatcggctacgcgcccacttggcgggccctggctggggatgtgcgagactgggccagtgccattcgcgtcgcagctctggactgcatggaagagaagaaccaggccgtgtgccatgactacgacatccacttctaccccaccttccggtattttaaagcatttacaaaggagtttacaactggagaaaattttaaaggacctgaccgagagctgcgaacagtcagacagacgatgattgacttcctgcagaaccacacggaaggaagccggccccctgcctgcccgcgcctagaccccattcacgtgaagcctctgcgggccttcttttcgtcttatttgaagtcattgccggatgtgaggaaaaaatcgcttcccttgcctgaaaagccacacaaagaagaaaattcagaaatcgtggtttggagagaatttgacaagtcgaagctgtacacggtggacctggagtcagggctacactacctcctgcgggtggagctggcagcccacaagtccctggccggagcagagctgaagacgctcaaggactttgtgactgtcttggccaagctgttccctggacggccgccagtcaagaagctgttggagatgctgcaggagtggctggccagccttcccctggacaggatcccctacaacgccgtgcttgacctggtcaacaacaagatgcggatttctggaatattccttactaatcacataaagtgggttggatgtcaaggaagccgatctgagttgaggggttacccgtgttctctctggaaactgttccacactttgactgttgaagcctcgacccacccagatgcactggttggcacaggctttgaagacgacccccaggctgtgctgcagacaatgaggaggtacgttcacaccttctttgggtgtaaggaatgtggtgagcactttgaggaaatggctaaagaatccatggactcggtgaaaaccccagaccaagccatcctctggctgtggaagaagcataatatggtgaacggccgcctggcaggccatctgagtgaggatccccggtttccaaagcttcagtggcccactccggacctctgcccagcctgccatgaggaaattaagggcctggccagctgggatgaaggccacgtgctcacattcttgaagcagcactatggccgcgacaacctcttagacacgtattccgcagaccagggggattccagtgaaggaggaaccctggccaggggtgaggaagaggagaaaagactcactcccccagaggtgtcccatggagaccgagacacccagagcgtccgtccacctggtgcactgggccccaggcctgcccttccagagagcttgcatcacagcttggacgggaaactccagagtctggatgggcccggggcccacaaggaggtgggcggggccgcacccttcctcggggttgacttctccagcctggacatgagtctctgtgtcgtgctgtacgtggcttcatccctgttcctcatggtgatgtacttcttcttccgggtgaggtccaggcggtggaaggtcaagcaccaccacccggccgtgtgagtgcccgggtgctgccagccacggcggaagctcccttggaggcagccctgccccgtgccacctgcagctttaatatttatgatcagggattttataaacatgcgggcctggtttcacatcggatggcaccttttggcttcaaagtcctggttttacaaacgctcttctaacaagggaagaacacggggtaattttgtggggatatttgcattcctggcgtactcaagtctgttcatgctccttttgcaggtcttacagcaaaaagacttctgtatttttactcttctagatgtgaaaagagggtgcagagtccaggccagatagtcttccccacacactttcatctcgtttcctccactccgccccatcctgcagggccttgtttttgtatttggagaacctcgcccatcccccccgcggctcctggctcccccccactcccctcgctccccctccccccgctccccccacgccccctgctccaggctgccaagtgttttcctttagccgggcggggacagacagagccggaagcgcagtcggcctctgcagcccctccaagcaagtgctccagggactatcctgtgtttgtagctgcttccctagggcaggttcctgagggctctccttgttcctccgggtgttcgacaccagacgtggggatttcaacaggggaggagccaaggaattctgtggctgtgctgcgtttcagaaaataacccccagaggccttgggctgtggacctgggggttggaaggatgggggctcatttaaccctcagaggcagcgcctttgtctgtctatctggtgacaagagagagacaagtaaatgggggccgttgggacggcgggtgcctggagggcagctctgggctcagcgggcagtgcttagagcacaggcccctctgttgggggatggggaggagagcagtctgcccttgggagcgtaggccccagggagacttctaaagccccccctgtcgtctgctcttcacccagcaccacagaggcacctgctgcacacacaagcatctcactcggcccacggagggggccaggcttcctttgcctgaagctgttttgggaagggtctccacacaggcactgatctcccaagcttttgtcatgatgtcttttaccatttgataattttaaacattgtttttaaacccaaaacatttagtggtccgttgcctctgaagatgtaaacaaacaaatacactatttctgggaacatttatattgagattctttgtggctattggtgtgtctcacaggcaaaatttgatttggctaaaataggctcagatgtatttgtgtgcccgtgtgtgtgtgtgtgtgtgtgtgtgtgtgtgtgtgtgtatgagagagagagagactttgacggttgtagatattttttccgctttgcctactttatgttgtataatcatgtgtttactaacaagttgatgacatggatgtattcataagaccatgtaatattgatgtgattgttgtcgcttgagaaaaaaaggcaacagctgattctttcaacaactgtcacagaatggctgggctgagaacgctgcccagggccctgcagctggcgggagaggtgtctggtgggagcggtgtctggtgcgtcagcctgctgcttcgtgtctcactcgagagttgcttctggtttcacactttttaacccctctgtgctttagcagccgtgaccttgccttcattgcttcatccagtgcaggcctgggttattgaagacaccaaagtgtttctcttccagtttgaaaaccaggcaggtttacacgtgggtttcagtgtatttgcctttgaacccttcaaactaaactttagccttttggctggtgttgaatgtctttagctggggtgacctggagtgacctgggacggtgttgtggtttaccgtctccagcttcagcctttccagaaacccttgtggagggcagtgttggctgcaggtttcatcatattgcagtttgaggtcaccactatttggggaacaagcttgcgtcctgctgaggggcaggattttcagcagagcgtcggtggggctgggccgtcgtggaggtggccccaggagtcatatggccatactcagacacaccttgtgtggcctgctcagagctggatgccacctttaggcaatgtttagagtctattttctaaagttttaagtattttaagaggtattgagactaatgaatataatagttcagtaatttaaatgcttatttattttcagtggaaggatttttattaaaaagaagctaattgacatggaaatgtcagtgaaatttcttacctgcaaggaaagtgaacattttgtatttaagtaaactataatgtgcacattttaataaagaaatctgacatttg

SEQ ID NO: 25146 - DNA, 1648 bp, Homo sapiens
acagtccctccgggtggcggggcgccccgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgttgatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactacatggactctgtcctggtatccttttcctgtgtggttgccccgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctgatgttctcagaagggggtggatttaaatcctgaaataaatatttcaacacaa

SEQ ID NO: 25147 - DNA, 913 bp, Homo sapiens
gactttcagggcctgctgaggaatctgcaggcctggcagaggacaggagggaggcttggggagcctgggaagggccggctgacagcttgatgggccctccctccctccacagtcccacccccagcctggggcctctgggagccttggtcctgagcagccaacacaccagcccagacagctgcaagtcaccatggacgctgaaggcggtgcgggcggccagacaggcggctgacttcactctgaaggtggaagtggaatgcagcagcctgcaggaggccgtgcaggcagctgaggctggtgccgaccttgtcctgctggacaacttcaagccagaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttca

SEQ ID NO: 25148 - DNA, 1648 bp, Homo sapiens
ggcctggcagaggacaggagggaggcttggggagcctgggaagggccggctgacagcttgatgggccctccctccctccacagtcccacccccagcctggggcctctgggagccttggtcctgagcagccaacacaccagcccagacagctgcaagtcaccatggacgctgaaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatggtgaaggataaccatgtggtggccgccggtggcgtggagaaggcggtgcgggcggccagacaggcggctgacttcactctgaaggtggaagtggaatgcagcagcctgcaggaggccgtgcaggcagctgaggctggtgccgaccttgtcctgctggacaacttcaagccagaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaacaaaggaaag

SEQ ID NO: 25149 - DNA, 610 bp, Homo sapiens
gacctggccccagtgctgcgtccttatcagccgagccgtcccacccccagcctggggcctctgggagccttggtcctgagcagccaacacaccagcccagacagctgcaagtcaccatggacgctgaaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctggg

SEQ ID NO: 25150 - DNA, 2088 bp, Homo sapiens
acacgcacgctacagtcgcccgtgcgcactcgtacacaccaggtggctaacaggtacgaggcgtttccggacagcgagcgcagagcccccgcgcacgcgcctccgagccggcctcttccgccgcaagtccctccccaagcctgcagagtgcgctgcgtttcgatgagccgggacgtggcgccgctctagccagcgcctgggctctgtggcgggcgccgcagctccgcgtcccccgcgcctcctcccagcgcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 25151 - DNA, 2265 bp, Homo sapiens
ctgcagagtgcgctgcgtttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 25152 - DNA, 1496 bp, Homo sapiens
gcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggcaattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttg

SEQ ID NO: 25153 - DNA, 1034 bp, Homo sapiens
gcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggcaattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatgcattttatatatcagaattacccaaagaaggagttgtcttcaaataaggaaacactaacggaatctctgttgcccaggctggagcgcagcagcacgatctcagcttaa

SEQ ID NO: 25154 - DNA, 512 bp, Homo sapiens
tacccaggaactgaccctgctctctcctttccctgttagacatgggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggtaatgtcagatttagtccattctacccaaaataccaatattaaaatgtactggtt

SEQ ID NO: 25155 - DNA, 1284 bp, Homo sapiens
gagaggcgcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggtcccactaagcagctggtctaactggagttaatggtctgctggaacttccagcatgcactgtggtagttatatcagcatatacaggagcactggaacagagggggccagtctaaaagataagggatgaacacagtgcaggccagagagaccagctgcttcatgggatgtgaaaaatctacttttataaagtagggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggcaattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaa

SEQ ID NO: 25156 - DNA, 3705 bp, Homo sapiens
agacctacccgggcgaagcgggcgagcggtggtttggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaa

SEQ ID NO: 25157 - DNA, 1966 bp, Homo sapiens
ccaagctaacgtttggacaaataatgttttgttatatttaacattaaaactctgacattgacattcacattcattttggaagcattatatttaatcatatgaaagttggtgaaccttggattacagattgcaaatgctaataagtcttttattagaatgatggcgtcttcataccatgaagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtgg

SEQ ID NO: 25158 - DNA, 553 bp, Homo sapiens
agacctacccgggcgaagcgggcgagcggtggtttggacgccggcggagacgcgggcgagaaaactgtggatttagttactccactctgccatgtctttccaccactgcctgcacatttgagaccaaggatagagattgggaaaaattgatagttctcctgcctcagagtttggctcctgcactctcatttcagccatagctgcagacaaagcacacgattgctgggcactgtggctcaagagaaggaggagatgtttgtttatatggagaagaatgaagaccatgtggtttcagtttgaacggaaattgttgcatagcgatttaccatacagctgtgagactgaacaaatgagtttaaatattatacagtagaaaagaaaactgactttggaacttaagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaag

SEQ ID NO: 25159 - DNA, 1902 bp, Homo sapiens; identical to SEQ ID NO: 23113

SEQ ID NO: 25160 - DNA, 2430 bp, Homo sapiens
cgcagccgtggctgaggagcctgtggcggcagcggcgatggaaccagcggagcagccgagcgagttagtgtcagccgagggccgaaaccggaaggcggtgctgtgccagcgttgcggctcccgggtgctgcagccagggaccgctctcttctctcgccgacagcttttccttccctccatgagaaagaagccagctctgtctgacggcagcaatcctgacggcgatctcctccaggaacactggctggttgaggacatgttcatttttgagaatgtgggcttcaccaaggacgtgggcaacatcaagtttctggtctgcgcagactgtgaaattggaccaattggctggcattgcctagatgacaagaacagtttctatgtggccttggaacgagtttcccatgagtaactgaggggaggggtactcagctccatctccaaagataaacctactccccacaagaactggcctttaatgtggtataactgttccgctgccttcttgtctgtgctaatataaatactgagtaccagcatgtccatttgaacatgcagagggttaatcctgcttcctaaagcctcaagtacatgcctcctgcttagttcactttgtatcacatttcctaagctcccttttcccccagttttgggacactgtgcttacctccaaaaatctcatctcttccctggcattctccctaggctctgttttgcccaggggctcccgctttttcttgctctagaagagcagtattcaaccttttagctatgatgacacataacaaaagatgcttatgtactaatagttgaaatctgcctttttctcattcaagaaggcatacaaatatctgagagtgactttgttgtatggctacccttgtgatctacagtaatttattctttctaaaggtaaagcattttcaaaactcagtatttaaaccactaaccagaaacattactttggatgcatctctaataccatgtttgagcacctctgctctaggttgagaatgacattttattgtgaagatgggtgtggtccctcttcccttgaaatcttgtagtttctttttatattagctcctcactgctacagcctagaaggtgagaagcagattttaaccccatctggcagccattcaaggaaaacccagccctggctgtttactcaggctctcttagaatgagagtggagggtgtaggatatgagggttaggcctttgccacattatacaaaagtttataatttgccacatctggacaagtaactttcttcttttgttcataggcaagacttctttaatggatagtatcatttactgaacctactgggcatggtcctcatggagttttggttcaactggaatctctgtgccaacccaggatacaaacttccatccagatgcatggatacaaatttccatagctccggggctgctctaacagtttgatatcagcagacgtgtttaagccttcaacttgatttccaattattccatcatttctattctgaaatgactcactgtcgtagaaggaagtttattatataaccaaggtttcaggtatcctcctgtcaccacctctactattcaggaggcctaaaattgaaataagtactaaacagaaaccttaccatctgaagtcccttccattgttttctagttgcttcctcattcctttacccccaaactttctaagggctccccgactgcagtgcaaggtggccttgggcacagttttgcaaccaacctactcccctggaaagatggcttccttctccaattagcctgaatgagctttagtaagcaattgagagaactgtgtttttccgacaaacggtcacatgtccatcgttatggcatgtgcagaaaaacagagttatccacacaagtcaggagcaaaacccaagtagatgcctctaggggcacatggcccctcacatcacaagccagaacctaagctaagcattttttaaattgagtttgagactagcctgggcaacatagtgagaccccatctctatttaaaaaatgaacaaaattacctgggcatagtggtgtatacctgtagtccctgctacttgggaggctcaggtgggaggatcacttgagccccaaagatggtggctgcagtaagccaagatcacaccactggcactccagcctgggcaacagagtgagaccctgtctcaaacaaacaacaacagtaacaacaaaaaaatatatagcgacttgaataggaaaccatagtatttcattgttttaatttgcatttattttatttctagtgaaacttttatatacgtatcggtcatttctatttccttttttgagaactgccaaatgttgccctagtagccaaaaatatcaggttgctattctgccttttcagtttgatctgaaagaaataaaggcatttaagcaatggaaa

SEQ ID NO: 25161 - DNA, 1752 bp, Homo sapiens
agctcttggacgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagccggggccctgggcactgagctgcaggatctggcgcgccgtttcgggccggaggcggcggccgggctggtgccgctagtggtgcgggcgctggagctcttggaacaggctgccgtggggcccgccccggactcgctgcaggtgtcggcgcagccggcggagcaggagctgcggcggctgcgggaggagaacgagcgcctccgcagggagctgcgcgcggggccacaggaggagcgcgcgctgctgcggcagctcaaggaggtcacggaccgacagcgggacgaactccgggcgcacaaccgcgacctgcggcagcgcggccaggagaccgaggcgttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcgggagctgctcacagaccaccgggtccccggccttctgctcgaggccatgaaggtggctgtccggaagcagcggaagaagatcaaggccaagatgttagggacaccagaggaagcagagagcagtgaggatgaggctggcccatggatcctgctctccgatgacaagggagaccatcccccacccccggagtccaaaatacagagtttctttggcctatggtatcggggtaaagctgaatcctctgaggatgagaccagcagccctgcacccagcaagctagggggagaagaggaggcccaaccacagtctccagctcctgatccgccctgttctgccctccacgaacacctttgtctgggggcctcagccgccccagaggcctgacttaggggtctggctgtggaaggatgtgtggcctcaaatgaggacagggctcccgccttcacagccctcgccaggggtctgccccaatcctggcctgcatcagggcaggacggggtctcagcccgcctccctctctacgtctctgtaccgagcctctggggccagatataagagtgcctctctgagtctcagtttccccatccatgaaatgagagctgactgcctagctcccagggctttgtgcagacggcctgagctcatgtaataaagaactgcccgtaatacacagaaa

SEQ ID NO: 25162 - DNA, 2608 bp, Homo sapiens
ctcgggagcagctccgggccgagccgggcgcccagaccccgggcccgcacaccccgcgccgccgcccgtgcccgcgcccgcgcccgccgcccgctgcccgctgcgccctcgccccagcgcccgctgagcgcgcccgcccgcggcccaggctgggcccggccggcccggccctcgacagcggcaagtttgggagttgcacgagtttgcggggcgggggacaggccaggagggtggccatggaggaggagcgggggtcggcgctggcggccgagtcggcgctggagaagaacgtggccgagctgaccgtcatggacgtgtacgacatcgcgtcgcttgtgggccacgagttcgagcgggtcattgaccagcacggctgcgaggccatcgcgcgcctcatgcccaaggtcgtgcgcgtcctggagatcctggaggtgctggtcagccgccaccacgtcgcgcccgagctggacgagctgcgcctggagctggaccgcctgcgcctggagaggatggaccgcatcgagaaggagcgcaagcaccagaaggagctggagctggtggaggatgtgtggcgaggggaggcgcaggacctcctctcccagatcgcccagctgcaggaggagaacaagcagctcatgaccaacctctcccacaaggatgtcaatttctcagaggaggagttccagaagcatgaaggcatgtcagagcgggagcgacaggtgatgaagaagctgaaggaggtggtggacaaacaacgcgacgagatccgcgccaaggacagggagctgggcctgaaaaatgaggacgttgaggctttacagcagcagcagacacggctgatgaagatcaaccatgaccttcggcaccgggtcacggtggtggaggcccaggggaaagccctgatcgaacagaaggtggagctggaggcagacctgcagaccaaggagcaggagatgggcagcctgcgagcagagctggggaagttgcgagagaggctgcagggggagcacagccagaatggggaggaggagcctgagacggagccggtgggagaggagagcatctccgacgcagagaaggtggccatggatctcaaggaccccaaccgcccccggttcaccctgcaggagctgcgggacgtgctgcacgagaggaacgagctcaagtccaaggtgttcttgctgcaggaggagctggcttactataagagtgaagaaatggaagaggaaaaccgaataccccaacccccacccatcgcccacccgaggacgtccccccagccggagtcgggcatcaagcgactgtttagcttcttctcccgagataagaagcgcctggccaacacacagagaaacgtgcacatccaggagtcctttggacagtgggcaaacacccaccgcgatgacggttacacagagcaaggacaggaagccctgcagcatctgtgaccttggcccatctccaccctccaacctggactgcccgccaccagcgcctgcaaccgaactgcagcccaggggtcattgctgcctcaagcctctcggtgcagatgcaccctgaaaactgacccctcaaacagactgtctgatttgaggatggacattgaaaaactgacgccaaactctaaagaaatgtttatttatacccagggctatcactgtttctaatagatgactctgatcccgtaggatatatatttaataatcccacaaacggaggccagacttctgcgttaacttcagtaacacaagcttctttaagccaaatacatcacttgccactatcattgctgtttgacttgctttgtataaaatgctatgtgtagaggttttattatcacaggtgacatagttcagcaggaggcatggaagggctagatcttcattagttacattcatgaaattgtgatggtaacgtattatacagaatgtatccatcaggcagacaaggggtctgaagtcacaggctcagtagcccaactcagacacaaagccacagacaatatggatgatggtcctcttacccagaaactggagacaactttgcaggcaccctggctgcgttcctgataatgcctagagcatgtagcaatgttcaaggcaggtgccttggaatctgctgtgagttatgcagtactaaccaaacaaagttgctaaggatgagatgttgcaacatttcttgtgtgcacttttttttcctgacatctttttttccttttaggattcattaagtcatatacttagtcccctgcaaagaagaagacagatgtcccagagcagactgaaagcggggcgtgggatcctaggcaatgcaggagggcaggtgggggagctgtagcagaacaagggtgctaggtgggaagctggcttggggaccacacgtctggctgactcacagggctatagcagcagacagagagccagatgctctactgcaactggtgagttggaggcttgcccacataacactgtctttctctccacccgccaagcatccagggcacagggctggttgctcacagattgagcgaggtagcacctcctaccagcactcaagtttatcagggccgcgttctaaacattctactgaagtttgctaagaaaccatt

SEQ ID NO: 25163 - DNA, 1435 bp, Homo sapiens
ctgaacttccccgttcctcttctcggctgcctccttttccgttgtcccttcgcgccccaaaccacatcctggagcgcactctccagcgtggctggcagcggggacggtgcgccggggcgcaggcccaagagtcgcgtgcgcggccccttgcaccatccccccgggcccacccccgggccgcgctgattgggcaggtagggactctgcccagcggaaagttttgggtgccgggaggaagtctaacctttgggagactccaagacagcagctccgaggtcggcgggggtctgggtggccatggaggagccccctgtgcgagaagaggaagaggaggagggagaggaggacgaggagagggacgaggttgggcccgagggggcgctgggcaagagccccttccagctgaccgccgaggacgtgtatgacatctcctacctgttgggccgcgagcttatggccctgggcagcgacccccgggtgacgcagctgcagttcaaagtcgtccgcgtcctggagatgctggaggcgctggtgaatgagggcagcctggcgctggaggagctgaagatggagagggaccacctcaggaaggaggtggaggggctgcggagacagagccctccggccagcggggaggtgaacctgggcccaaacaaaatggtggttgacctgacagatcccaaccgaccccgcttcactctgcaggagctaagggatgtgctgcaggaacgcaacaaactcaagtcgcagctcctggtggtgcaggaagagctgcagtgctacaagagtggcctgattccaccaagagaaggcccaggaggaagaagagaaaaagatgctgtggttactagtgccaaaaatgctggcaggaacaaggaggagaagacaatcataaaaaagctgttcttttttcgatcggggaaacagacctagatccaaggccacaagtaaggctatggctctgattctagaagacaaccttccaagatgcctggcaaaaccacctccctgtgccacacagacacactaggcctgtgtatttatttccccttcaaagcagactgaggagggaggagacgaggttctcttggcatcactttctccctggctgcagaactagacacccttgaagatttggcctgggccagtgagactgaaatcaagaaaaacagaagggatgtgcagggtgggggggtccacttcctgctcccatgtcaacccccagggcctccagcgtgcagacgcgtgtcctactcatctgctcccacggatgaccctggtcttcaatggttagcagaagggagaaaagaaagcaggaaaatgtgctattgagattccagtggtgacttcactgatatttagtgaatatttgatttagccaacatgcctttctttatgtgattttgtattaaagtaaaatgatttttatactttc

SEQ ID NO: 25164 - DNA, 2341 bp, Homo sapiens
cgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcacggtacaggtgaaagggggcagacccctcatcatgctttccaggcatctgccacttcccaggaattgtctccctggataaacaaggcgaagtccctggctgtgcagaagcagtagctgtgtggtggcacagtcaggaaaactcgggggccctgttgacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgacataaacgtgacccaaaaaagcttcaattttgccaagaagttctccctgcccctgtatttcgtctcggctgctgatggtaccaatgttgtgaaggtgtggttgactgcagaggtagctagcaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaa

SEQ ID NO: 25165 - DNA, 623 bp, Homo sapiens
actcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggaatagtttggaccttgtgcctcctgtgggaggctgaggact

SEQ ID NO: 25166 - DNA, 1118 bp, Homo sapiens
ctgcgaggacgcggggcgagccggaagtggagtgcgctgcggtgcgagctgggccggcggggtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggacttttgggacacggcaggccaggagcggttccagagcatgcatgcctcctactaccacaaggcccatgcctgcatcatggtgtttgatatacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataa

SEQ ID NO: 25167 - DNA, 1052 bp, Homo sapiens
ggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggacttttgggacacggcaggccaggagcggttccagagcatgcatgcctcctactaccacaaggcccatgcctgcatcatggtgtttgatatacagaggaaagtcacctataggaacctgagcacctggtatacagagcttcgggagttcaggccagagatcccatgcatcgtggtggccaataaaattgatgacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataa

SEQ ID NO: 25168 - DNA, 2179 bp, Homo sapiens
gcggttgcgtagcagctgcgaggacgcggggcgagccggaagtggagtgcgctgcggtgcgagctgggccggcggggtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggacttttgggacacggcaggccaggagcggttccagagcatgcatgcctcctactaccacaaggcccatgcctgcatcatggtgtttgatatacagaggaaagtcacctataggaacctgagcacctggtatacagagcttcgggagttcaggccagagatcccatgcatcgtggtggccaataaaattgatgacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgttttctttccaaagctcacctcggggacaattccttgggcttctcctgaggtaatgattacccccccacccacagctgagtctgtgaggccccatcctttccctacgttttctcccatcttttttcctcttcaatctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaacatt

SEQ ID NO: 25169 - DNA, 2282 bp, Homo sapiens
cgagagcgcgcagagtccagactggcggcagggcccgaggggccgacccgcagcgtccctggtctctccagccctcactcggaaccgcacggtacaggtgaaagggggcagacccctcatcatgctttccaggcatctgccacttcccaggaattgtctccctggataaacaaggcgaagtccctggctgtgcagaagcagtagctgtgtggtggcacagtcaggaaaactcgggggccctgttgacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggacttttgggacacggcaggccaggagcggttccagagcatgcatgcctcctactaccacaaggcccatgcctgcatcatggtgtttgatatacagaggaaagtcacctataggaacctgagcacctggtatacagagcttcgggagttcaggccagagatcccatgcatcgtggtggccaataaaattgatgacataaacgtgacccaaaaaagcttcaattttgccaagaagttctccctgcccctgtatttcgtctcggctgctgatggtaccaatgttgtgaaggtgtggttgactgcagaggtagctagcaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgttttctttccaaagctcacctcggggacaattccttgggcttctcctgaggtaatgattacccccccacccacagctgagtctgtgaggccccatcctttccctacgttttctcccatcttttttcctcttcaatctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaa

SEQ ID NO: 25170 - DNA, 556 bp, Homo sapiens
ctgcgaggacgcggggcgagccggaagtggagtgcgctgcggtgcgagctgggccggcggggtggttcgagagcgcgcagagtccagactggcggcagggcccgaggggccgacccgcagcgtccctggtctctccagccctcactcggaaccgcacacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggacttttgggacacggcaggccaggagcggttccagagcatgcatgcctcctactaccacaaggcccatgcctgcatcatggtgtttgatatacagaggaaagtcacctataggaacctgagcacc

SEQ ID NO: 25171 - DNA, 2041 bp, Homo sapiens
ccggaagtggagtgcgctgcggtgcgagctgggccggcggggtggttcgagagcgcgcagagtccagactggcggcagggcccgaggggccgacccgcagcgtccctggtctctccagccctcactcggaaccgcacacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggacttttgggacacggcaggccaggagcggttccagagcatgcatgcctcctactaccacaaggcccatgcctgcatcatgcagacataaacgtgacccaaaaaagcttcaattttgccaagaagttctccctgcccctgtatttcgtctcggctgctgatggtaccaatgttgtgaaggtgtggttgactgcagaggtagctagcaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgttttctttccaaagctcacctcggggacaattccttgggcttctcctgaggtaatgattacccccccacccacagctgagtctgtgaggccccatcctttccctacgttttctcccatcttttttcctcttcaatctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttcctttttt

SEQ ID NO: 25172 - DNA, 2140 bp, Homo sapiens
tgcggcgcgagctgggccggcgggcgtggttcgagagcgcgcagagtccagactggcggcagggcccgaggggccgacccgcagcgtccctggtctctccagccctcactcggaaccgcacacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaaca

SEQ ID NO: 25173 - DNA, 2428 bp, Homo sapiens
agcagctgcgaggacgcgggccgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcacatggcaaggacacggacaagcaagtcttcgcccgtaagcggtggctcacgcctatagtccagggatgccgaggagggaggatcgcttgagtccaggagttggaggctgcagtgagccgtgatcgcgccaccgcactccagcctgggcgacagagtgagaccctatctctaaacaaaagaaagaacgtcttcaagcatggagccatgaagctggatttggctttctgtcgctctctctacagggtacagacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaa

SEQ ID NO: 25174 - DNA, 2169 bp, Homo sapiens
gctgcgaggacgcgggccgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaa

SEQ ID NO: 25175 - DNA, 391 bp, Homo sapiens
ggtacaggtgaaagggggcagacccctcatcatgctttccaggcatctgccacttcccaggaattgtctccctggataaacaaggcgaagtccctggctgtgcagaagcagtagctgtgtggtggcacagtcaggaaaactcgggggccctgttggtattttctacccctgacccgtgtgcatacttctgtcgtagctctcaccacagtagactctgctatcattgtgtcttccatcctctgaaccctgtgcaaggtctgctcatggtgaatgcccatgacaataccctcccctcccttgggctggacccctctctacagctaggagccaatggcagaagacaaaaccaaaccgagtgagttggaccaagggaagtatgatgctgatgaca

SEQ ID NO: 25176 - DNA, 1126 bp, Homo sapiens
gcagctgcgaggacgcgggccgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaacattg

SEQ ID NO: 25177 - DNA, 3535 bp, Homo sapiens
gagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggacgggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgagttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgggtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttctagatggtctacttctgttcatataaaaacaaaacttgatttcca

SEQ ID NO: 25178 - DNA, 6253 bp, Homo sapiens
ctcgcttctggagtgttatcgtcaccatgtccctaatggtctcggctggccggggcctgggggccgtgtggtccccaacccacgtgcaggtgacggtgctgcaggcgcggggcctgcgggccaagggccccgggggcacgagcgacgcgtacgcggtgatccaggtgggcaaggagaagtacgccacctccgtgtcggagcgcagcctgggcgcgcccgtgtggcgcgaggaggccaccttcgagctgccatcgctgctgtcctccggacccgcggccgccgccaccctgcagctcaccgtgctgcaccgcgcgctgctcggcctcgacaagttcctgggccgcgccgaggtggacctgcgggatctgcaccgcgaccagggccgcaggaagacgcagtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgacttcatcctgtgaagccaatgaatgcaatggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaaatcagcagaaaaaaaacaccgagacgtttctgtgacttcactttcacctgctccaggggtcaaggacttgccttgcctgataaccagccagcaggctccgaatcaccatctccctcacatgttatccggcaagagtgaattctaccaatggaagccaggttaatgattacaattaatcttttactgtacattcccaaggctttagttttaaatgccactgtgcctttaacaaggttgtaaatattttatgcccaccagagatgtggtcataagatctgatcctgagccagagattcagatggcacaggaagtattcatgtattttaacactggggttttctttctttcatactgagattttttttcagtatgtatcctccagctcttaaagcttacctgagaaagctttaaatgagaaaaggaccatgcgattggtgctgtgttacatacacatactttcttggcttctgagtagctcaggtgtggcttttggctgcagatgttaaattttgataccatgtaaacctacccagcttctcagacttgggtcttgttttttgatgggaacagaggtgtttagagaaagcctctgagtatgcctttcagattttgaacaagcggccttttctaaacatcgacttctactactctctagccttaaaataccttctgcttagatccagggcccttctactggagataggaaaagtagaattcaggaattaaaagaattactctttattcaatttgaggaacttggtgaaagcccctcctcttatgacagccaggttcctgctggctagaccagcctattcagcgctttgctaggggattgggtggtccacgcactcgctaatacagttctccaggtgtggaatgatgtcaatacgattgcttggccttttccccctgtgcctttgctcggtgctctggtttcctcagcaacactccttgtaaggggcagagacagggtccaccaactccccaagatgaagaagccccttcaggccagtcgtggtggctcatgcctgtaatcccagcactttgcaaggccgaggagggtggatcacttgaggtcaggagttcgagaccagcctgaccaacatggcgaaaccccatctctactaaaaatacaaaaattagcttggcatggtggtgcgtgcctgtaatcccagctactcgggaggctggggcaggagaattgcttgaacttgggagatggaggctgcagcgagccaagatcgtgccactgcactccagcctgggcaagagtttttttaagactcttaaaaaaagagcctgggcaatttttttaagactctgtcttaaaaaaaactaaaaagaaaaaaagaagccccttcactctacaggggacaggagaccatggattggaccccaaagggattgaactgcatctgcatgtctgtcctttgaacactttctctccctgcccaaaaggaaacccaaattatttgtgggatactggggaaattgtagtgaagggcttaatgtagttaataaaagttaaaagtcagtagaaaacaggtgcctcagccttcaaatggttgctttttttccattttccctcatgaatagactcaccagcattttacccccttgttataaaactgtgcagagcaagaagatgatacttatttttgaatttgtatttttaaaactagatttatagactttttttttttttaactagggcacttgcttccttcttagctaaaagcaccagctgagatttttcaggtaattttgttgttactcacttaagactggaattagaatgtttctggtatttctcatttttttccctggctatgatagaatctcatctaatcttgacatctctcctaggggaagaatatcacaggctaatagcgtggttgggggtgaagatgatagcagttattaaatcaggaatctcttttatgtgtgtccttgttacattgaggttaagagacaaaatcattggcagtgcaatctctttccaggatttcgtttgctgtggcattggttatatcagagcactttaatctgaaggatgatactgtaacttgatttatctaattagcttttaattatctacagctattttattttatttaattctctcctacagtactgggaccactgtaaacttctcagatgacttgtatttttgtagtgctatgaaatttatttacatacttataaagaaaactgtatgttcacttgaactctgaaaatgtacatgtatggctggacgcggtggctcacgcctgtaatcccagcactttgggaggctgaggcgggtgaatcacttgattgaggtcaggagttcgagaccagcctggccaacatggcaaaaccccgtctctactaaaaaatacagaaattagctgggtgtggtggcagacagctgtaatctcagctgctcgggaggctgaggcacaagaatcgcttgagccagggaggtggaggttgcagtgagctgagatcacatcattgcactccagcctgggcaacgggcgagactctgtctcaaaaaaaagaaagaaagaaaaggtacatgtatatatttgtcctgcattatgttttttacttgatataaatgtatttttactgtgatagtccaagtgccctggggggcaggtgtgctctatgtggttcttcttccattggagagctggcgtagagatctgcagtgttcacaaggatgttggtttggagatgtctgctgctaggacctggggtgtgtgactcagtccatatgagagggacatctgggtggaggagtaaattcctgtgctctgaaatgccacttggtagctctggacaatgaaggacaattgactcaagggtgcctggcttctgctgctgctgggaaaaaattcagtttatagcattcctgcacctcccaaagtagataacctggaggtcattcagttaacaactgtccctgaggactcagttttgggggaggggttatctgggagaagctttagcctgttctgagccattaggagacattagtgaattggagcactggagaatcctacaaatggcctatgtctcagaagagctgggacctccttccagctgctgcagatgctgacaggccctgggaggctgctgtgctctggagaagctggagcagctcatttcttggcctagcctggctgcctcagaaagagcagtcaggacttgagggaagcatcaaattctatacccataaactgcagttggaagtcagctttttgaaatgtccagcctttgcccaattgtttcagatcatctcatgcctcaggctttggcaggtatcctgccctccatcttattccagtgtgttcacctcatcaaggcagcagagtggatgaaggagtaagtctgccctttgccatactgaacagctgtggaccccgattggtgagggctctgcatatgcctgtatgaaggagatacaggtgtgtgtgcacatgccggtatgaagaagacacaggcatgtgcttctcagttttgctaacagtgggagctcaacggggcagagggaggaaggtccatgatgctcagccacatactgtagagagaggcaatttaatgttaaatgacgcaccatcctccctcccacccttctcccagtcaactttttttctttttctagaactactaattatctctcaaggctgaaaaattaattgccttaggtggagaacttaattcctagtatccaccaaacttaactccgtatctccatatggtgtctccatatctactgtgtgagctacttaactgacgccctcttcctccaactgaaggatcgcccaacgtttttggattatagaattattatttcctgctttctttctttgggacttttgaatttctttggtttcgtttttaagaagtaacccaacatttcctacaacactaaataaaatggtacttacctttcaaagatttgtgtctgtagtttggtatgggtgcaataaaaatttattttgtcttcctggaaaacctctcttggtgggggtggggggatgaccagtgtttctcatcccatgagggtctctcactgggatttctgttgctgccatcttgcctggttcccaggagtcccaaggccctttttctcaaagaggacggacatgtctggtcccttcggatgcacccttcatcttggcctgagggaccatggcactggccagagaaactgagttggaacgtgctgcccccttttcctttgcagccggtacccttggctgagcatttggacagggtctttcctc

SEQ ID NO: 25179 - DNA, 7811 bp, Homo sapiens
tgttatcgtcaccatgtccctaatggtctcggctggccggggcctgggggccgtgtggtccccaacccacgtgcaggtgacggtgctgcaggcgcggggcctgcgggccaagggccccgggggcacgagcgacgcgtacgcggtgatccaggtgggcaaggagaagtacgccacctccgtgtcggagcgcagcctgggcgcgcccgtgtggcgcgaggaggccaccttcgagctgccatcgctgctgtcctccggacccgcggccgccgccaccctgcagctcaccgtgctgcaccgcgcgctgctcggcctcgacaagttcctgggccgcgccgaggtggacctgcgggatctgcaccgcgaccagggccgcaggaagacgcagtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgactggaagtgtctccagaggcgcaacccacagccaggcttccttcccctactgactccccttcctctcttcctcctcttccttctagctctggccaggcatctgtcccctctgaattgggacatggtgcagacacacagtcctctgagagtccttctgtcttctcctctctctcatctcccatagcagctcccatttccacatccactccaattgaaagctggcctctcgtagacaggggccaggccaagtctgaaggaccacccttgctccctaaggcagagttgcaaactgagagtttaacaccggttccaaattctggttcttctgccctgggatcacttttcaaacagccatcctttccagcaaataaagggacagaagattctctgatgggcaggacccgtgagacaggcacagagaagaacaccagcagccttgagttggaggagtctctcccagagcagcctgaaacagggcgacaagaggaagaacttccgagattcccctgcaaaaaacaagactacagcccatcatctggagaagcccaggaagtaccgtttgccctttcactcagcagtgatggagctgtgagccctgttggggagcttgcagcaggaggagacagagacttggagagtcaggctgggtctcttgtggagagcaaagccagggatgcagctgaagaagtggcgccccctcttcccatgggagcatcagtcccttccattgattccatgatgcggaagctggaagagatgggtctgaacctccgcaaggaccagaagaaaaccaagaagcgtgtgtcattttctgagcagctcttcacggaagaggcagtggcgggggctgccttgctggtggaaggacacagcagttgtccccaggagctgaaccctgcatggtctgttgctggaaacgcgtctgacggagagcctcctgagtctccccacgcagaggactcagaaagggaatcggtgaccacacctgggccagcgacgtgtggtgcgccagcctccccagcggatcacctcctcctcccctcccaggaggagagtttctccgaagtccccatgagtgaagcaagctcagcgaaagacactccactctttaggatggagggagaggatgcccttgtgactcagtatcagagcaaagccagtgaccacgaaggtttattgtctgaccccttgagtgaccttcagttggtctcagattttaaatctccaatcatggccgatctgaacttaagccttccttccattcctgaagtcgcatcggatgatgaaagaatagatcaggttgaagatgacggagatcaggttgaagatgatggagagacagcaaagtcgtcaactctggacataggagctttgtccttgggcttggtagtcccctgtcctgagaggggaaaggggcccagtggcgaggcagataggttggtactgggggagggcctgtgtgatttcaggctgcaagcaccccaggcatctgtgacagctccttcagagcagaccacagagttcggaattcacaaaccacatcttggcaagagctcaagcttggataaacagctgccaggccccagtggtggtgaggaagaaaaaccgatgggaaatgggagtccaagcccgcctcctggcacatccctggacaatcctgtacccagcccctccccttctgagatctttcctgtcacacactctttccccagctctgcacattctgacactcaccacaccagcacagcagaatctcaaaaaaaagccacagcagagggctccgctggtagagttgaaaattttggcaagaggaagccactcctccaggcctgggtctcaccctcggagacacatccagtctcagctcagccaggcgctggaactgggtcagccaagcacagacttcatcctgtgaagccaatgaatgcaatggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaaatcagcagaaaaaaaacaccgagacgtttctgtgacttcactttcacctgctccaggggtcaaggacttgccttgcctgataaccagccagcaggctccgaatcaccatctccctcacatgttatccggcaagagtgaattctaccaatggaagccaggttaatgattacaattaatcttttactgtacattcccaaggctttagttttaaatgccactgtgcctttaacaaggttgtaaatattttatgcccaccagagatgtggtcataagatctgatcctgagccagagattcagatggcacaggaagtattcatgtattttaacactggggttttctttctttcatactgagattttttttcagtatgtatcctccagctcttaaagcttacctgagaaagctttaaatgagaaaaggaccatgcgattggtgctgtgttacatacacatactttcttggcttctgagtagctcaggtgtggcttttggctgcagatgttaaattttgataccatgtaaacctacccagcttctcagacttgggtcttgttttttgatgggaacagaggtgtttagagaaagcctctgagtatgcctttcagattttgaacaagcggccttttctaaacatcgacttctactactctctagccttaaaataccttctgcttagatccagggcccttctactggagataggaaaagtagaattcaggaattaaaagaattactctttattcaatttgaggaacttggtgaaagcccctcctcttatgacagccaggttcctgctggctagaccagcctattcagcgctttgctaggggattgggtggtccacgcactcgctaatacagttctccaggtgtggaatgatgtcaatacgattgcttggccttttccccctgtgcctttgctcggtgctctggtttcctcagcaacactccttgtaaggggcagagacagggtccaccaactccccaagatgaagaagccccttcaggccagtcgtggtggctcatgcctgtaatcccagcactttgcaaggccgaggagggtggatcacttgaggtcaggagttcgagaccagcctgaccaacatggcgaaaccccatctctactaaaaatacaaaaattagcttggcatggtggtgcgtgcctgtaatcccagctactcgggaggctggggcaggagaattgcttgaacttgggagatggaggctgcagcgagccaagatcgtgccactgcactccagcctgggcaagagtttttttaagactcttaaaaaaagagcctgggcaatttttttaagactctgtcttaaaaaaaactaaaaagaaaaaaagaagccccttcactctacaggggacaggagaccatggattggaccccaaagggattgaactgcatctgcatgtctgtcctttgaacactttctctccctgcccaaaaggaaacccaaattatttgtgggatactggggaaattgtagtgaagggcttaatgtagttaataaaagttaaaagtcagtagaaaacaggtgcctcagccttcaaatggttgctttttttccattttccctcatgaatagactcaccagcattttacccccttgttataaaactgtgcagagcaagaagatgatacttatttttgaatttgtatttttaaaactagatttatagactttttttttttttaactagggcacttgcttccttcttagctaaaagcaccagctgagatttttcaggtaattttgttgttactcacttaagactggaattagaatgtttctggtatttctcatttttttccctggctatgatagaatctcatctaatcttgacatctctcctaggggaagaatatcacaggctaatagcgtggttgggggtgaagatgatagcagttattaaatcaggaatctcttttatgtgtgtccttgttacattgaggttaagagacaaaatcattggcagtgcaatctctttccaggatttcgtttgctgtggcattggttatatcagagcactttaatctgaaggatgatactgtaacttgatttatctaattagcttttaattatctacagctattttattttatttaattctctcctacagtactgggaccactgtaaacttctcagatgacttgtatttttgtagtgctatgaaatttatttacatacttataaagaaaactgtatgttcacttgaactctgaaaatgtacatgtatggctggacgcggtggctcacgcctgtaatcccagcactttgggaggctgaggcgggtgaatcacttgattgaggtcaggagttcgagaccagcctggccaacatggcaaaaccccgtctctactaaaaaatacagaaattagctgggtgtggtggcagacagctgtaatctcagctgctcgggaggctgaggcacaagaatcgcttgagccagggaggtggaggttgcagtgagctgagatcacatcattgcactccagcctgggcaacgggcgagactctgtctcaaaaaaaagaaagaaagaaaaggtacatgtatatatttgtcctgcattatgttttttacttgatataaatgtatttttactgtgatagtccaagtgccctggggggcaggtgtgctctatgtggttcttcttccattggagagctggcgtagagatctgcagtgttcacaaggatgttggtttggagatgtctgctgctaggacctggggtgtgtgactcagtccatatgagagggacatctgggtggaggagtaaattcctgtgctctgaaatgccacttggtagctctggacaatgaaggacaattgactcaagggtgcctggcttctgctgctgctgggaaaaaattcagtttatagcattcctgcacctcccaaagtagataacctggaggtcattcagttaacaactgtccctgaggactcagttttgggggaggggttatctgggagaagctttagcctgttctgagccattaggagacattagtgaattggagcactggagaatcctacaaatggcctatgtctcagaagagctgggacctccttccagctgctgcagatgctgacaggccctgggaggctgctgtgctctggagaagctggagcagctcatttcttggcctagcctggctgcctcagaaagagcagtcaggacttgagggaagcatcaaattctatacccataaactgcagttggaagtcagctttttgaaatgtccagcctttgcccaattgtttcagatcatctcatgcctcaggctttggcaggtatcctgccctccatcttattccagtgtgttcacctcatcaaggcagcagagtggatgaaggagtaagtctgccctttgccatactgaacagctgtggaccccgattggtgagggctctgcatatgcctgtatgaaggagatacaggtgtgtgtgcacatgccggtatgaagaagacacaggcatgtgcttctcagttttgctaacagtgggagctcaacggggcagagggaggaaggtccatgatgctcagccacatactgtagagagaggcaatttaatgttaaatgacgcaccatcctccctcccacccttctcccagtcaactttttttctttttctagaactactaattatctctcaaggctgaaaaattaattgccttaggtggagaacttaattcctagtatccaccaaacttaactccgtatctccatatggtgtctccatatctactgtgtgagctacttaactgacgccctcttcctccaactgaaggatcgcccaacgtttttggattatagaattattatttcctgctttctttctttgggacttttgaatttctttggtttcgtttttaagaagtaacccaacatttcctacaacactaaataaaatggtacttacctttcaaa

SEQ ID NO: 25180 - DNA, 429 bp, Homo sapiens
atgtccctaatggtctcggctggccggggcctgggggccgtgtggtccccaacccacgtgcaggtgacggtgctgcaggcgcggggcctgcgggccaagggccccgggggcacgagcgacgcgtacgcggtgatccaggtgggcaaggagaagtacgccacctccgtgtcggagcgcagcctgggcgcgcccgtgtggcgcgaggaggccaccttcgagctgccatcgctgctgtcctccggacccgcggccgccgccaccctgcagctcaccgtgctgcaccgcgcgctgctcggcctcgacaagttcctgggccgcgccgaggtggacctgcgggatctgcaccgcgacctgggcaagagtttttttaagactcttaaaaaaagagcctgggcaatttttttaagactctgtcttaaaaaaaactaa

SEQ ID NO: 25181 - DNA, 1959 bp, Homo sapiens
acactggatcctatctttgtctagcgcgtgtcttctcaaaaataaaagtgcaaaataaaaaacaaaacaaaagaaataaaagtgcaaattctgctctcagccgggtgcagtggctcacgcctgtaatcccaacattttgggaggctgaggcgggcggatcatctgaggtcaggagttcgagtccagcctggctaccatggtgaaaccccatctctactaaaaatacaaaaattagctggacatggtcacgcgctcctgtaatctcagctactcaggaggctgaggcaggagaatcacttgaacccaggaggcagaggctgcagtgagccgagatggtggcattgcactccagcctgggtgacagagcaagactctgtgtcaaaaaaaaaaaaaaaaaaaaaaaaaaaaattctgctctcatctaccacttcccgaagagaaagcatgagaatgcatgcattgaagaggctgctggtagcagagaggagaggccagttcatggggattgtgaacattgttgcagttgcttccattcaaaggtaactcctcagcctttctcctttcaggtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgacttcatcctgtgaagccaatgaatgcaatggccaccaaggttgctaactgcagcttgggaactgccaccatcatcagtgagaacttgaacaatgaggtcatgatgaaggtatgtcctctgagaagctggtgtgttcgttag

SEQ ID NO: 25182 - DNA, 6061 bp, Homo sapiens
gggcgggcgggaggcgcggaggcagcggaggctgctcggccgcaaggaggcaggcgggaggccaggggtgcagaattggggcgggggctcccttcacccccgcagccctccgcccgggtccgtgtggccaggcctcacgtgccccgcaggcctggggaaggtggagacaggggcgggggtccgcgcagaggcctgcacggcgcggccaggtgatggtgggcctctgtgtttctccagacgaaaggggacccccggagcggccgtgcccctgggctgcccccgcgaggcgttttgacatcagccatagggaagtcggggagccctgagcctgcctgtttccgttaagtgtccttaggatgcagtgattaaggaattaggctctccctccgggaggggcactgcctgtgctagggaactcgggggcagagaaacaggacaggatgatgctgtccgagcaagcccaaaagtggtttccaacccacgtgcaggtcacagtgctccaagccaaagatctgaagccaaaaggcaaaagtggtaccaatgacacatacactataattcagctgggcaaggaaaagtactccacctctgtagctgagaaaacccttgagccagtttggaaggaggaggcctctttcgagctacctggattgctaattcagggaagtccagagaaatacattcttttccttatagttatgcacaggtccctggtgggtctggataaatttttagggcaggtggcaatcaatctcaatgacatctttgaggacaaacaaagaaggaaaacagagtggtttagattagaatccaaacaaggaaaacgaatcaaaaacaggggtgagataaaggtcaatattcagtttatgaggaacaatatgaccgcaagtatgtttgacttatcaatgaaggacaaaaccagatctccttttgcaaagttaaaagataagatgaagggtagaaaaaatgatggaacattttctgatacgtcttctgcaatcattccaagtactcacatgcccgatgccaatagtgaattttcaagtggtgaaatacagatgaaatccaaaccaaaaaagccttttctcttgggtcctcagcgactctcgtcagcgcattcaatgtctgatttatctgggtcccatatgtcttctgagaaactgaaggctggcaccataggtcaaacacatcttctcggacaccagttagattcctttggaacagttccagaaagtggaagtctcaaatctccacacagaagaacattaagctttgatacttctaaaatgaaccaacctgacagcattgtggatgaaggtgaattgtgtttcggaagacaaaatgacccatttacaaatgtgactgcttcattaccccaaaaatttgcaacactgccaaggaagaaaaatccatttgaagaaagcagcgaaacatgggacagcagcatgaatttattttcaaaaccaattgaaataagaaaagaaaataaaagagagaaaagggagaaagttagcctgtttgaaagagtgactggaaaaaaagatagcagaagatctgataaacttaacaatgggggatctgatagcccttgtgacttgaaatcacctaatgcatttagtgaaaatcgccaggactattttgattatgagtcaaccaatccatttacagcaaaattcagggcttcaaatataatgccatcttcaagttttcatatgagtccaacaagcaatgaagacctcaggaaaatcccggacagcaacccctttgatgccactgcagggtatcgtagtctgacctatgaagaggttctacaggagctggtgaaacacaaagaactccttaggaggaaagacacccacatccgggaactcgaggactacatcgacaacctccttgtaagggtaatggaagaaacgcccagtattctcagagtgccgtatgaaccatccaggaaagctggcaaattctctaacagttaataaagccaattgtattgtattgataattggacaaagagagagaaagaaagaaggaaggaaggaaaaacttgttactgaaagagactacactatcaggtttcattacatattctcctttattgtgaagagtagttttacctgtaaatattagcagggactatcaagagtgacctttgaagcaagctaaatcatttaaatgtttaaattgaaaatgggccagattctcaatgaataagtggttccttaggactcactcaggtgctggtactgacccactaatctgccataggcccagaaatatcttcagaagtacgtgagttgttcctcaggaatagatttttcataaagcagaattgatcctgtggctggtttctcagaaatcagtttgtagaaatatttagcttcaggaatactgctcgttataaacactactaaaaaaacagtttatattttatatacacatatgtacatgaatatatatatattcatgtatcttgtatataaaatataggcatatacctcatatatacatgtgtttttagaacatttagaaacaattgattgcctctaaagttaggctaccaatttcttgatttgaaaatgtgtgtgctctattgatgcaagacaagtcatccttcctactgtcatggtttgttatagagaagctgcttcaaatcactcttgactacatggaccttggtttcaaagtgagctgctatatattattctagcatcaaagtttttctctttccccaaaagtgatgatctcaagtccttttttaaagaatgacaaattttaggagacttcattaacttcataacagcatgaatttatttgaattaattaacatttgagtttgtttaaggtataagcagaagataagctaatatagcttgttttgttgaaattctgcatgcctttaaatcactagcaaagcaaatattataaagttatatctgaaaataattgtgggaagtatgtgattgcctggtgtgtctgataacccaaagcagcgggcagattccaggaatgaagaattaggcttggtttcaggttacataaataatagagcagatggttgcctttgggtcttgaaccaaaataagacttactaaaggaagagtgagtttttagaagagaactttacgagcgtgacattatgcattactccacatccaccctttaagaattgatttattacaaaattatgttctattttaaagtccactcccccaaaatactgatttcttccatggattatttttatatgatttgtacaaattttttctgaaatttaaattgacaagcaatgttataaaaatattgctaatcttctgcttatttttcagcctttaaagtctgaaatactataaaacactgagagtatctatgtctttctgaatttaaaatgaaaattcatgtccatatggagacttacatattccccaatctttccatgaattgcatttttttctaatacttatctctgttaagactccattgaaagttaaacaaaaagccgatataatagtttgggttttttttttttgcttattttagtattttgaatcagagaatacttggccaagctcgtatttgtaaactaaaaccccttgttatttgtatcttctgcatttcagttttactgtaagaacatacattttgaaattatgaacatttttttcataaaaattaaatgctttaagaaatggagaaggaaaaatagcttttatcaatttttttctcctcaagattctgtaataaacctcaaagtctggtgtagaatggtattttcccgtttgaggtcttggtagttttttttttttttttaaacatggtgccacttttaattaactaaatgttacaaaattctcagcatttgtttttgtctggtagtattattgagtcttttcatacacttcttaaaatgtgaaaatctatgttttcagtattatgacagtatctgcagatactataataatatgctttggccaaatttgctgtttatagagtgaaccaagatgtcagttttgtattggggatatgttttacataaatagaactcatttaaaagtatggttcaagtactgctcttctttttatggggaaattgatttttaaggagcgattcttttcctatataaaagctattgaggcttagctttattcatacatgagtgatttggttataactcaatcaaaatttttatctttaaatctgagacaagtattatatttaaaactagatctattaatacattcatcactgcctgaaaatttgctgttctaatgtttgtgaattttcactcattacctagagtaaacttattgcatattttcataatcagtcaaaataataaaactaaaaacaaaaagtaaaaattagttcccaagtaaatatatcagtgtttcctgtgtttgggcagaagtgcaaagtagttttaatttctcacgttgtagaaaaagaggccaaaaaggtcaccttagtttatttttccaaaacataactttaggtattctaatgtattttgttagttgcttagaaatggaaataaaatatatgtgcttattaaataatgcacagtacactagattatagagtttatttttgcttttatgctttaaagaatgcatgcccaaaacactactaccaacaagaggattttttaaaatcacagaattgatatttatctcaagactatcttaagctaatgtacttctgttacataattaaactatttctgctattatttttaaagcagtattattttataaccaattctaaaattcagctttaaaaatattgaacataccttcctaccacttacgcttcaagtttcatttattgaataccagggtcatatcttagaattgtatataaaacaacatgtaacccattcatgaaaaacgtttttaagtattgctttttgctgctatgttctgcattgagcctagttttgccattgtcccctgaatgtagtattatctatagattatacataactacatctattgcttttggtggtaaatcaagatttagttgtaattttccagctgtgaaaatgttgccttgtatttaaaagggtttcatgaatggaaacctaagtaaaactaagctcattagtgacagacttgttttcttcttgttattcctccagcaactccctcaccaccacgcctccctgcctaccatccccggaagggtgcttattctttaacaaagagaatctaaaaaaaaaaacaaaaaactgttgtctaatatatctacagtaaatgttacactagagcttttattttcctctgtagcttttcagaagaagcaatttaccttggatttgtaaatcaagctgaaacttttttgatgttcatgtactcatatgtcttgtaggtggtaggtgtcacttgtgtgtatgtgtaagtgaagtatgatgcatgctcattcacttggtccctttgaaataagggaaaggatcacagtgctgctgggccatgatggtatgtagaagggtctgtcagcacacatggaaagcccccatttgcacagatgtagaactttaataatccagatgcaatcattggaagtatttaatatgcaattggtagcaccttagctaattaatctgcatatgaagcattttctgatatatttaataagaggtatagaagctcttcaagcattaaaatagagttgatgtttcattccatttgttttatccatcaaaaaatgcactctcacagtggagttgaagtctaatacatgatacatgtgggcctgttagtcttcgaagcttccagatggtttgtgttttgaggtacaaaaaaatgctgcagatctagaaatgcatatatttagcgggtatttgaaagatagaagcattatttataactgaagagtataacacttatcttcttaagtaaatgctctcataacttgtatacatttttgcaggtacaaattcaaaagtatgtaagcattgtataatgtgacaattgtataatttatgtaatctgatgcatgaatcagaatttttatataatatatgattattgacttatagttgattaaagtgtttaaacttaa

SEQ ID NO: 25183 - DNA, 1599 bp, Homo sapiens
atgatgctgtccgagcaagcccaaaagtggtttccaacccacgtgcaggtcacagtgctccaagccaaagatctgaagccaaaaggcaaaagtggtaccaatgacacatacactataattcagctgggcaaggaaaagtactccacctctgtagctgagaaaacccttgagccagtttggaaggaggaggcctctttcgagctacctggattgctaattcagggaagtccagagaaatacattcttttccttatagttatgcacaggtccctggtgggtctggataaatttttagggcaggtggcaatcaatctcaatgacatctttgaggacaaacaaagaaggaaaacagagtggtttagattagaatccaaacaaggaaaacgaatcaaaaacaggggtgagataaaggtcaatattcagtttatgaggaacaatatgaccgcaagtatgtttgacttatcaatgaaggacaaaaccagatctccttttgcaaagttaaaagataagatgaagggtagaaaaaatgatggaacattttctgatacgtcttctgcaatcattccaagtactcacatgcccgatgccaatagtgaattttcaagtggtgaaatacagatgaaatccaaaccaaaaaagccttttctcttgggtcctcagcgactctcgtcagcgcattcaatgtctgatttatctgggtcccatatgtcttctgagaaactgaaggctggcaccataggtcaaacacatcttctcggacaccagttagattcctttggaacagttccagaaagtggaagtctcaaatctccacacagaagaacattaagctttgatacttctaaaatgaaccaacctgacagcattgtggatgaaggtgaattgtgtttcggaagacaaaatgacccatttacaaatgtgactgcttcattaccccaaaaatttgcaacactgccaaggaagaaaaatccatttgaagaaagcagcgaaacatgggacagcagcatgaatttattttcaaaaccaattgaaataagaaaagaaaataaaagagagaaaagggagaaagttagcctgtttgaaagagtgactggaaaaaaagatagcagaagatctgataaacttaacaatgggggatctgatagcccttgtgacttgaaatcacctaatgcatttagtgaaaatcgccaggactattttgattatgagtcaaccaatccatttacagcaaaattcagggcttcaaatataatgccatcttcaagaaatactttgctgacccctgcagtagctgaatggagaggatctttgagatgggcagagctttttcatatgagtccaacaagcaatgaagacctcaggaaaatcccggacagcaacccctttgatgccactgcagggtatcgtagtctgacctatgaagaggttctacaggagctggtgaaacacaaagaactccttaggaggaaagacacccacatccgggaactcgaggactacatcgacaacctccttgtaagggtaatggaagaaacgcccagtattctcagagtgccgtatgaaccatccaggaaagctggcaaattctctaacagttaa

SEQ ID NO: 25184 - DNA, 4831 bp, Homo sapiens
cgttagttctccgggtacctcaggcgcctcagcctccttagtctcctcatcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgcccttccgcaccactagcctctcgggagcatggcgtcggccccgccggcctcgcccccgggctcggagccgccggggcccgacccggagccgggcgggccggacgggccgggggcggcacaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtgaaggacttaactaagtacttggatcccagtgggctcggcgtgatcagctttgaagacttctaccaagggatcacagccatcagaaacggagatcctgatggccagtgctacggtggtgtcgcttctgcccaagatgaggagcccctggcctgcccggacgagttcgatgacttcgtcacctatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcaggagaacctgcagctggtgcacagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggctacagcaactggacgaggagaacagtgaactccggtcctgcacgccctgtctgaaggccaacattgagcgtctggaggaggagaagcagaagctgttggatgagatagagtcgctgacgctgcggctcagtgaagagcaggagaacaagaggagaatgggggacaggctgagtcacgagaggcaccagttccagagggacaaggaggccacccaggagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggacaaccgcaacctgaaggagcagaacgaggagctgaacgggcagatcattaccctcagcatccagggcgccaagagcctcttctccacagccttctctgagtccctggctgcagagatcagctccgtctcccgagatgagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatatatatatgtataatatataaagactggcaccctgcctctctgtgcccaggcccagccctggtgacatggcaccactcagcagtgctgtcactgtaagcatggactcccaggagacagtgtgggaaacgctcctgctttaattccccgagaaacggctcttcctgcctggatgcaggagggcaggggccaccacagattaaagctgttactgcacacgcagaggccggcttcttcctccaggggggccacagggtggggtgggagtcttctgggcctggcccagcttccctcaaggcgtccgaggccatcagttgtctgagctcagaacccagcagacctgcctggctctgcagcttggtcagactaagacccttccaaggccgtaggattgcacctccaggcccagtggagcctggcagctttccagccaggttctggatcctgacgagctgctgagacagcatcaaggtggggcaggtggggcggggcaaattgggcagcacagggctgtgtgggcatcagggctctgggtcacacgcctctggggacgtacgtcccatgtcgggagagccgtcaaaacgtccccgggattaagagaagagtggggggcagggcgcagaggctcacgccataatctcagcactttgggaggccaaggcaggaggatcgcttgaacccgggagttcaagaccagcctgggcaacatagcaaggccccatctctaaaaaataaaaaattaaccagg

SEQ ID NO: 25185 - DNA, 3022 bp, Homo sapiens
atgtctctgcttagagccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcaggagaacctgcagctggtgcacagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggctacagcaactggacgaggagaacagtgaactccggtcctgcacgccctgtctgaaggccaacattgagcgtctggaggaggagaagcagaagctgttggatgagatagagtcgctgacgctgcggctcagtgaagagcaggagaacaagaggagaatgggggacaggctgagtcacgagaggcaccagttccagagggacaaggaggccacccaggagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggacaaccgcaacctgaaggagcagaacgaggagctgaacgggcagatcattaccctcagcatccagggcgccaagagcctcttctccacagccttctctgagtccctggctgcagagatcagctccgtctcccgagatgagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatatatatatgtataatatataaagactggcaccctgcctctctgtgcccaggcccagccctggtgacatggcaccactcagcagtgctgtcactgtaagcatggactcccaggagacagtgtgggaaacgctcctgctttaattccccgagaaacggctcttcctgcctggatgcaggagggcaggggccaccacagattaaagctgttactgc

SEQ ID NO: 25186 - DNA, 3203 bp, Homo sapiens
attagagcgtgtctgggagcaggttaaactttctcctaggtggtgatgtgcctccaggtgagcgcacaggctttgcagaaaccccagcatgacaagcaagtaggaaggtgacattgttgtttgagaaaagccagtgacccggttgggacggagacacgatggggagccggtctccaacagcatgcccttcctgaaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcaggagaacctgcagctggtgcacagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggctacagcaactggacgaggagaacagtgaactccggtcctgcacgccctgtctgaaggccaacattgagcgtctggaggaggagaagcagaagctgttggatgagatagagtcgctgacgctgcggctcagtgaagagcaggagaacaagaggagaatgggggacaggctgagtcacgagaggcaccagttccagagggacaaggaggccacccaggagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggacaaccgcaacctgaaggagcagaacgaggagctgaacgggcagatcattaccctcagcatccagggcgccaagagcctcttctccacagccttctctgagtccctggctgcagagatcagctccgtctcccgagatgagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatatatatatgtataatatataaagactggcaccctgcctctctgtgcccaggcccagccctggtgacatggcaccactcagcagtgctgtcactgtaagcatggactcccaggagacagtgtgggaaacgctcctgctttaattccccgagaaacggctcttcctgcctggatgcaggagggcaggggccaccacagattaaagctgttactgc

SEQ ID NO: 25187 - DNA, 804 bp, Homo sapiens
caggttaaactttctcctaggtggtgatgtgcctccaggtgagcgcacaggctttgcagaaaccccagcatgacaagcaagtaggaaggtgacattgttgtttgagaaaagccagtgacccggttgggacggagacacgatggggagccggtctccaacagcatgcccttcctgaaggtgtgtacagagccaggcccagcctgtgaggccacccgggccagcatctgagggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcagg

SEQ ID NO: 25188 - DNA, 4384 bp, Homo sapiens
tcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgcccttccgcaccactagcctctcgggagcatggcgtcggccccgccggcctcgcccccgggctcggagccgccggggcccgacccggagccgggcgggccggacgggccgggggcggcacaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtgaaggacttaactaagtacttggatcccagtgggctcggcgtgatcagctttgaagacttctaccaagggatcacagccatcagaaacggagatcctgatggccagtgctacggtggtgtcgcttctgcccaagatgaggagcccctggcctgcccggacgagttcgatgacttcgtcacctatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagcactgaccctcttgccgcaaagctgcacagcatcctcactgatgaggcgtttgagttttactgtagccagtgccacaaacaaatcaaccgccttgaggatctttctgcccgcctgagtgatcttgaaatgaatagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcaggagaacctgcagctggtgcacagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggctacagcaactggacgaggagaacagtgaactccggtcctgcacgccctgtctgaaggccaacattgagcgtctggaggaggagaagcagaagctgttggatgagatagagtcgctgacgctgcggctcagtgaagagcaggagaacaagaggagaatgggggacaggctgagtcacgagaggcaccagttccagagggacaaggaggccacccaggagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggacaaccgcaacctgaaggagcagaacgaggagctgaacgggcagatcattaccctcagcatccagggcgccaagagcctcttctccacagccttctctgagtccctggctgcagagatcagctccgtctcccgagatgagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatatatatatgtataatatataaagactggcaccctgcctctctgtgcccaggcccagccctggtgacatggcaccactcagcagtgctgtcactgtaagcatggactcccaggagacagtgtgggaaacgctcctgctttaattccccgagaaacggctcttcctgcctggatgcaggagggcaggggccaccacagattaaagctgttactgc

SEQ ID NO: 25189 - DNA, 8625 bp, Homo sapiens
ccttcccctccccactcttctccttccctcccctcccctcccttcccctccggagcggctggggctgcggcgccgctgctgacacggatcggccgcggccgccaccgggcggaggctgcgcggcgcagacccagacgggcggccccggagggcgcgcggcgatggcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtggaaaaacttgtgaaatatttggatcccaacgacctggggagaatcaacttcaaggacttttgccggggggtgttcgccatgaaagggtgcgaggagctgctgaaggatgtgctgtcggtggagagcgcggggacgctgccgtgcgcgccagagatcccagactgcgtggagcagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccagggtgcagcagttggaggaagaaaatacagagcttagaacaacagtgactcggctcaagtctcaaacagagaaactggatgaggagcggcagcgcatgtctgaccgtctggaggacaccagcctgcggctcaaagatgagatggacctgtacaagcgcatgatggacaagctgcgacagaaccgccttgagttccagaaggagcgggaggcgacgcaggagctcatcgaggacttgcggaaggagctggagcacctgcagatgtacaagctggactgcgagcggccaggcaggggccgcagtgcctcctctggcctaggcgagttcaatgccagggcccgcgaggtggagctcgagcacgaggtcaagcggctcaagcaggagaattataagctgcgggatcagaacgacgacttgaatgggcagattttgagcctcagcctctacgaagcaaaaaacctctttgctgcccagactaaagcccagtctctggctgcggagatagacaccgcctcgcgcgatgagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagctcgtgtttccggtactgggtaaaatgattctacctctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagccctctgtgatgtgtgtgcagagtgaacagaggactcaggtttcatagcagctagtgcggggcatcctcatcctgtacctatagagttcgtgcactcccccatccatgctacctacctccccgtttctgtttcagttttaagacaatgaagcagcattcactgcgtcattgtaacatgaagggataaaaatgaaggagaaggagggtttgggatgggtgtctaaggcaggagttgacatcgggcaaccaaagaaatgagttttggggaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttccccctgcagtttcttgctttcttcagcacatcttatagtatgagaaggaaggtttgggcatgttgggaagggcggtggagggggagttgcagaaagagagggcagtgagggtgaggagaggggatctggggacttgggtgtgacacctgcttgacagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatctgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgagctgctgacctcaagtgatcctcccacctcagcctgccaaagcactgggattacaggcatgagccaccatgcctggccaggacatatttgaaatggggagattttaaaaattctgatgattagactgaatcctcagacgttctggtttgattgttgtgggtgtagcccaggcatgggattttttaaagagctgctcaggtaattccaatttaattgcgtgtcctacttgggttttttgtttgtttttattgtttttgctaaacctggcaaccctaccgagtagggattagcagtaacttatctgaaatttagaggtgttttgggggtggggcgagggtttctgtagtagactcagattttacatggccctgagctgcccttgcgttcagttggaagccacgcaaaatgaactgaaccaggagtgagcttcgtgtacattatctattagaaaatgaagtaccttctggttcagctagtccctgtgcgttgagaggctttaagaaacttctagtaaaaatgtttttttcttttagctttgaattggccagagtttatcctagattattttattttaaattggtagaattctttgcgaactgtcacagagaaattccttttcatgactttatttctgacctattaaaacatgaacaggccaggcatggtggctcacgcctgtaatcctagcacttgggaggcagtggcaggcggatcacttgagctcaggagtcctaaaccagcctgggcaacatagtgataccttgtctctaccaaaagttaaaaaaaaaaaaaaaaaagctcaagaacctgcacgagggcctaaaacagtgggctcagctttggctgtgcattggaatcacctggggagatttgtaagcttctgctgtctgggctgaacccccagaggttcggattgaattggtgtggggtgtggtccaggcatcgagatgtgtaaagacctccccaggtgatgatatgcagtccgaggttgagactgccctgtcctgcaaggtcgttggccagaggtagaggaaactggtcaaagtggctgttgggcttgtcaagcccgtggctgaatgacagtgagctctcttgctgggagggttccttttcctgttgttgaatggtcctggcctgcaggatgggaggccagatgccttcaggagctggtggatccagctgttctcaccagcctggaggttagcagaccagagtgggtgggcaggaccttggcctggtgcccctggaatcagtgggtggcatgtgttgggatatactggctacaggctcatctcaaagagcaggtagaacagagtcagcagggaactgacaggtggggctgtccccctgaaagcagccgcagaaacagctgccacctatttgcatagctgagcaggaggacatactgtctttgtgggttttgcttctggtctgtttcctgactgggttgataaagggagtcccagctcgttccctgttagccaaaccagcatcctactcacacaccggacactccaggtgctagtccactggtgctggtgttcaggggagttggggggggggggcgcggggacagaagcgcgggttcttggttccaatgagggacttagcagaagcctccaggggccagcagggccaggtgaaactgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaactcttgtctttatttttttaaaaaaacaaaaagtaactttcgatgtgatcataccaggaaagttttgcgtggtcaccatgccaagaaaatgactttggttgcccagcagatccacagcgactctttctcaagggctactgtggattctagattgaggaaaggggccacttaggactcagtgctggtatcctccacagtcctttctcccagactctggccctccctttgggacccaggaaatcccctctagggtgacgctgctggctaggaagactgaggtctgctgcgccaaggggcctcaagttagaagggccatgccgttcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggcctttcccgagccctgtaaatgtgtactttttcaacgtgcctcccccaggtgaggccagctctcccgggcacattcgtccacaaggatcaggccccacttacccttggctcgctcagcctgtagacttggtaactttgtacagaatctttcattattgtcttaagcatggggggctaggacccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttctcgc

SEQ ID NO: 25190 - DNA, 8629 bp, Homo sapiens
ccttcccctccccactcttctccttccctcccctcccctcccttcccctccggagcggctggggctgcggcgccgctgctgacacggatcggccgcggccgccaccgggcggaggctgcgcggcgcagacccagacgggcggccccggagggcgcgcggcgatggcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtagaaaaacttgtgaaatatttggatcccaacgacctggggagaatcaacttcaaggacttttgccggggggtgttcgccatgaaagggtgcgaggagctgctgaaggatgtgctgtcggtggagagcgcggggacgctgccgtgcgcgccagagatcccagactgcgtggagcagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccagggtgcagcagttggaggaagaaaatacagagcttagaacaacagtgactcggctcaagtctcaaacagagaaactggatgaggagcggcagcgcatgtctgaccgtctggaggacaccagcctgcggctcaaagatgagatggacctgtacaagcgcatgatggacaagctgcgacagaaccgccttgagttccagaaggagcgggaggcgacgcaggagctcatcgaggacttgcggaaggagctggagcacctgcagatgtacaagctggactgcgagcggccaggcaggggccgcagtgcctcctctggcctaggcgagttcaatgccagggcccgcgaggtggagctcgagcacgaggtcaagcggctcaagcaggagaattataagctgcgggatcagaacgacgacttgaatgggcagattttgagcctcagcctctacgaagcaaaaaacctctttgctgcccagactaaagcccagtctctggctgcggagatagacaccgcctcgcgcgatgagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagctcgtgtttccggtactgggtaaaatgattctacctctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagccctctgtgatgtgtgtgcagagtgaacagaggactcaggtttcatagcagctagtgcggggcatcctcatcctgtacctatagagttcgtgcactcccccatccatgctacctacctccccgtttctgtttcagttttaagacaatgaagcagcattcactgcgtcattgtaacatgaagggataaaaatgaaggagaaggagggtttgggatgggtgtctaaggcaggagttgacatcgggcaaccaaagaaatgagttttggggaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttccccctgcagtttcttgctttcttcagcacatcttatagtatgagaaggaaggtttgggcatgttgggaagggcggtggagggggagttgcagaaagagagggcagtgagggtgaggagaggggatctggggacttgggtgtgacacctgcttgacagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatctgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgagctgctgacctcaagtgatcctcccacctcagcctgccaaagcactgggattacaggcatgagccaccatgcctggccaggacatatttgaaatggggagattttaaaaattctgatgattagactgaatcctcagacgttctggtttgattgttgtgggtgtagcccaggcatgggattttttaaagagctgctcaggtaattccaatttaattgcgtgtcctacttgggttttttgtttgtttttattgtttttgctaaacctggcaaccctaccgagtagggattagcagtaacttatctgaaatttagaggtgttttgggggtggggcgagggtttctgtagtagactcagattttacatggccctgagctgcccttgcgttcagttggaagccacgcaaaatgaactgaaccaggagtgagcttcgtgtacattatctattagaaaatgaagtaccttctggttcagctagtccctgtgcgttgagaggctttaagaaacttctagtaaaaatgtttttttcttttagctttgaattggccagagtttatcctagattattttattttaaattggtagaattctttgcgaactgtcacagagaaattccttttcatgactttatttctgacctattaaaacatgaacaggccaggcatggtggctcacgcctgtaatcctagcacttgggaggcagtggcaggcggatcacttgagctcaggagtcctaaaccagcctgggcaacatagtgataccttgtctctaccaaaagttaaaaaaaaaaaaaaaaaagctcaagaacctgcacgagggcctaaaacagtgggctcagctttggctgtgcattggaatcacctggggagatttgtaagcttctgctgtctgggctgaacccccagaggttcggattgaattggtgtggggtgtggtccaggcatcgagatgtgtaaagacctccccaggtgatgatatgcagtccgaggttgagactgccctgtcctgcaaggtcgttggccagaggtagaggaaactggtcaaagtggctgttgggcttgtcaagcccgtggctgaatgacagtgagctctcttgctgggagggttccttttcctgttgttgaatggtcctggcctgcaggatgggaggccagatgccttcaggagctggtggatccagctgttctcaccagcctggaggttagcagaccagagtgggtgggcaggaccttggcctggtgcccctggaatcagtgggtggcatgtgttgggatatactggctacaggctcatctcaaagagcaggtagaacagagtcagcagggaactgacaggtggggctgtccccctgaaagcagccgcagaaacagctgccacctatttgcatagctgagcaggaggacatactgtctttgtgggttttgcttctggtctgtttcctgactgggttgataaagggagtcccagctcgttccctgttagccaaaccagcatcctactcacacaccggacactccaggtgctagtccactggtgctggtgttcaggggagttggggggggggggcgcggggacagaagcgcgggttcttggttccaatgagggacttagcagaagcctccaggggccagcagggccaggtgaaactgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaactcttgtctttatttttttaaaaaaacaaaaagtaactttcgatgtgatcataccaggaaagttttgcgtggtcaccatgccaagaaaatgactttggttgcccagcagatccacagcgactctttctcaagggctactgtggattctagattgaggaaaggggccacttaggactcagtgctggtatcctccacagtcctttctcccagactctggccctccctttgggacccaggaaatcccctctagggtgacgctgctggctaggaagactgaggtctgctgcgccaaggggcctcaagttagaagggccatgccgttcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggcctttcccgagccctgtaaatgtgtactttttcaacgtgcctcccccaggtgaggccagctctcccgggcacattcgtccacaaggatcaggccccacttacccttggctcgctcagcctgtagacttggtaactttgtacagaatctttcattattgtcttaagcatggggggctaggacccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttctcgcctga

SEQ ID NO: 25191 - DNA, 4930 bp, Homo sapiens
agcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttatagggggattatttcttatgctgtcagattacatttttcctttgagtgctttgggtgcagccgtggaatcctgatgtaaaagcataggttcttgcattactgagtaaacattgaattgggagcatcagtgtgtgaattcagctttgattttagaactgcagttcaattatgctttccttggaaaaagtatgtccaaaaacattaggaaagtagtgtgtattttcatatataacagtgtcaccagacccaggaaaagaaaccatctctattttattgaaagttggtggtagattttttacaaagtaaggagaaaagagaaaaactaaatagtgaattgaaaatgaataaagtaaacttagaatttttacccaagtgtagacttaaatgttgctttgagtatggctggatcttgggagaattccaggaaatattaggtattagaaaatgactttgattgcatttcagcaggtgtctttattctgagtagtatcttaggagacaaactgtctcaagcaagaaacaataaatttttaaatattatgacagttcagggcttaaggcagtttagaagtattttgctacttgaccttgattttcagttattttaactttgaatttttttttttttttttgagacggagtcttgctctgttgcccaggctggagtacaatggcaccatctcagctcactgcaagctccacctccagggttcatgccattctcctgcctcagcctcccgagtagctgggattataggcgccagccaccacgactggctaattttttgtatttttagtagagacggggtttcaccatgttagccagggtggtctcgatctcctgacctggtgatacacccacctcggcctcccaaagtgctgggattaaaggcgtgagccaccgtgcctggccttgaatttttttttaacctgttatatagtctcctgaatagttagccatggtgccttgatttaatcttatgtcattgttctcaaatgccatgatttctctttaatagtagttgtcattatgtaagggtaagttattgcccatttaattgtaattataagaagaggtgccagctagtgaccttacatcagtgatcttttaagttctgaagggttctgcagaaaagttacacttcttgagtttgggttgcccatcagagctggtcacatttctttgatcattgaaaaaatgaatatcttaatttttgtctttgctgactggtatttataaaatacaaatgcttttagtgggttgagctgttgtgataatctcttccatctaccttagagaagaagctgtactatttagacagttttggccaacactagaagcaaaagaattcaaaggctgggtggatatttaagaacttattctaacctgtcaggtttcaatttgtggggcttggtttaacagaggaaaaaaatataaattgattttctgatgtctcacaaatatcacatacctggaaaaaaattaaaacaaaaaatgaattttgtaaaaggttatgtatgacttccatttgctctgtaaaaaaatgaacaaagattgtgaaaggatcctcttccaccacatcatttaatgggttagcggaacagatagggagctatgacactagcaccaaagagagatttttcttctggttgggtggtgctggtgccacgcccctttctgggatttgacaagtctttcccactcacctatacaatatgccaaatcaactggagttgtcattctaatgttttaaagaatgattgggttcccccaaactgtaggaggtcgatggtaacaataaagtgatacaaaatgcttatgtcattataatttatgtaagggagaccattaggctgagaatcaatatgattgaggttatctattctcctgaaaagtgaattggagaataaagaaagaatatttgaaaggatgttgtgtactaggcaatatactagcatgtattagaaaatacggtaaactgtgggttagaagagtgaaagtagctggtatgatagagcactggactgagtaacgaagagattctagtcatggctcttgtggtcatttcatttttgagcctcacattcttccaattaatgagggtaccagattaaataaactctggggattcatcccaattcgaactctgtaattctctgaatgaactctctcttcaattaaagccaaattattaacattttaactcaagtttaaatttaatagagaagtcaaaatgaggtatgcactttgtggaatgtttttggtcttatcacaataacctgattaaaatggtgcctttatttccatgtttactcctttaaataagatgaaagctttcagaacatttatttgcaaaatgactgtcaatatcaacaatatgcatcaaagtaccatatatgctaagggagaggagcacttgatgggctgctatgttaactgtaaattgagaactgcttgttttatggcttttgctgttaaaaaaaaactgctggcttttaatatgtactttaaaatatactcatgtctgggagagaacttttaaaaaca

SEQ ID NO: 25192 - DNA, 562 bp, Homo sapiens
gttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcaggttataataaagcaaatgtcagacagacgcgaaaatga

SEQ ID NO: 25193 - DNA, 1176 bp, Homo sapiens
gggaggaaaacttcttcctggcctgggctccgtgccgctctgtttgccaaccgtccagtcccgcctaccagtgccgggcgctccccacccctcccccggctcccccggtgtccgccatggccaaagcctacgaccacctcttcaagttgctgctgatcggggactcgggggtgggcaagacttgtctgatcattcgctttgcagaggacaacttcaacaacacttacatctccaccatcggaattgatttcaagatccgcactgtggatatagaggggaagaagatcaaactacaagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgaggagaaaaaggagaaaagggaaaagcagaaaggaaaaaaaggaagagagaggaagggagaagggagaggaatgaattgaggaagtgaaagaaggcaaggaggtaggaagagagggaggaggaaaggaaggagagatgcctcaggcttcagaccttacctgggttttcagggcaaacataaatgtaaatacactgatttattctgttactagatcaggttttagggtcctgcaaaaggctagctcggcactacactagggaatttgctcctgttctgtcacttgtcatggtctttcttggtattaaaggccaccatttgcacaaa

SEQ ID NO: 25194 - DNA, 4145 bp, Homo sapiens
atcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaaattggttgcattattttctgaactataatagggtttttcttcaggtgaacaatttgacgtgtcatcagtttttattgcagcactgtccatattcattgtataaagagaggtctacgtatgtagcatataaaaccacatcactaagtaatagacccacagctttattcttgtgtttacattacccttgaaatgttttcagtcaacccttttcagtgtaagatcagcacatttggtggctgatgctgttctcctttgactgtaccgggagccagattctatcatatgcatgtgtaatcccctgtaatacactcaggtgctcacaaatagagcagattgtcatattgtaacatgcgtgtgccagacaccgggcagtacactttggaaagaatgtgaaatccttttaatttttaatccatagcttactgcttgtgcagtcacctgcctcttgaggttgctcattgcccttggacctgtgaggaggccttcagattagtaattggtgcttagtactatttatgcttaaatagatcttccagtacaatgttgaagtcttttttatggataataacgtgtttgatggagtaacttattatttttttttggttggtggtttacacgttaatagaggtagtacaatttctttggaaaggtgtcttttgaagccagctgttaagcttcatacattacctcccttctcaaattcggtaagacagtagttttggggaacttttttgcccatgtgtcttttaagtgtgattttaaaaaaatgagtggttcagttcattcccctaaacagaagaaaagaccaaataattaccttccattcctcttcatgtgggaatatagagagggttcatgtggcattttagagaaaagataatttatcctcattcaacacaggcccagaaaattgtgtcccagaaggatgtcagtaattgtgactaggccaggccttttagcattttgctaagacttgaaacaaaaaatgtaaatacaaaagaaatcaagttttgttttgaaagatgccttctagaacttactgtgtattaataaattgtcactttcattgtctttattgtaactccattgatcccgtatcttaacggttcacgtctagccaaataactgttttggaataaaaaccttggtggtga

SEQ ID NO: 25195 - DNA, 711 bp, Homo sapiens
acatgcgcccctctcaagtgctggcagaccactgtgcatgcagacaacgcacccaaagggaagaatcaggggaacagtaacgcaaccctgccagcatgccaatgtagaaaacttgaaagaatgaacacaaaaatgtttacaaaggatatcatggcagagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttgga

SEQ ID NO: 25196 - DNA, 1139 bp, Homo sapiens
aacttttactttgaaaaagaagtacgtctgaaccagattcacatgtttgatatttggatgcagagaaaatggggcagaaagcatcgcaacagttggctctgaaggacagcaaagaggtgcccgtcgtctgtgaggtggtcagtgaagctatagtccatgcagctcagaaactgaaggagtaccttggatttgaatatcctccaagtaaactctgcccagctgcaaatactctgaatgagatcttcttaatccatttcatcactttctgccaagaaaagggagttgatgagtggctgaccaccaccaagatgaccaagcaccaagccttcctgtttggtgcagactggatttggaccttttggggatccaacaagcaaataaagcttcagctcgcagtacagactctgcagatgtcttcacctcctcctgtggaatctaagccttgtgacctttccaatccagaatcaagggtagaggagtcttcctggaagaaaagtagatttgataagctggaagaattctgtaacttaataggagaggattgcctgggtctgtttatcatctttggtatgccaggaaagcctaaagacatcaggggagttgtcctggacagtgtcaaaagtcagatggtgaggagccatctgccaggagggaaggctgtggctcagtttgtcctggaaactgaagattgtgtgttcatcaaagagctgctcagaaattgtctgagtaagaaagacgggctgagagaggtgggcaaggtttatatcagcattctctgacttggatatgtattatgtgagtggcctgtaagaggaaaagaaaaaaagattctaataagcaagctcacctatttgcatcattccagcatgggattttttttcatttgttttcccattgattgaaaatgattactgggatcaaagtacattcatgtcgcaattacagagagagagagaaaaaaagaaaaccctggctctgcctatgatttaaaaacagttcaggaaaagttataatttagtttaatatttcattcacttattcaataataaaaatggaagagagataataaagtcacatttaaagtttgatttgcaaaaaaaaagtgtctgtttgaaataataagtctagcactcaaaagt

SEQ ID NO: 25197 - DNA, 1966 bp, Homo sapiens
actcagttgcctctggccagtgcagggctcagccagggatggcttctagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccggaataaagctgaaaaacgggctccagttgggtgccaggaaatgcaggactggaatgtgacttgacttccggcagcgcgcaggtgctcccgggtcacctgctttgaggtccagcctcctgccctgcctcaggtgaccacatgaccactgtggactttgccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtaagtccagcttggctcttcggtacgtgaagaacgacttcaagagtatcctgcctacggtgggctgtgcgttcttcacaaaggtggtggatgtgggtgccacctctctgaagcttgagatctgggacacagctggccaggagaagtaccacagcgtctgccacctctacttcaggggtgccaacgctgcgcttctggtgtacgacatcaccaggaaggattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccacctggacggtggccccctcagcctggcagcctctggacagagaggaaggaaggattggaaaagtccccgcagcacagcgacggtgggaagatgccttacgtctgatcttgatgggggcactggcctggagcctgggcccacctgcttctggggggttggggagcaggccagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgacaatctg

SEQ ID NO: 25198 - DNA, 1209 bp, Homo sapiens
agtgaccgggcctggggaacagggcatggcacaggcacacaggaccccccagcccagggctgcccccagccagccccgtgtgttcaagctggttctcctgggaagtggctccgtgggtaagtccagcttggctcttcggtacgtgaagaacgacttcaagagtatcctgcctacggtgggctgattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccacctggacggtggccccctcagcctggcagcctctggacagagaggaaggaaggattggaaaagtccccgcagcacagcgacggtgggaagatgccttacgtctgatcttgatgggggcactggcctggagcctgggcccacctgcttctggggggttggggagcaggccagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgacaatctg

SEQ ID NO: 25199 - DNA, 2835 bp, Homo sapiens
tggcagacgtggagcggcgcgcatgcgcagcagctcactctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcagatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctagatgcatttgtgtaggaagtatatacatttccctattactctcatcagctgaagaatatgtactattgtgttactcaaattatgtggctttcattttgttgttttgttgcaagcttagtgttttgtagtggaggttttgtaaatgaaacagttgtaatatctaaggtcaggcacctagtaacagggttttgttaattcttttcagaatcattgaagcagtcttaaagggtcttttgcagatggtacaaattagaacaattagaatatagtattttgagttctagtagtactgagattgacccaaacaaataaaaaactattcaatttctgagtaa

SEQ ID NO: 25200 - DNA, 617 bp, Homo sapiens
cacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaatagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttg

SEQ ID NO: 25201 - DNA, 873 bp, Homo sapiens
gcgcctgcctggttcccggcctttgccaggcccaagttctctgggtcgctctccctcctgtagcgccgagaaaacaccattccgagggccgccgctcggccggcagtcggctgtgaaagaactggatcttgtgactgctggaaaatttcgctttagtgtaaggtccgagtgcttcagccgtgggccacctttgaaaataaaatgtaattgttatttctcattttgccacatcctgtggagacagaagattagtgttgtgctttcattttttactttttccttggggaaaataatattgacagtggagttgagtataagcctgctcttgaggttcacagatgatacgtttgatccagaacttgcagcaacaataggtgttgactttaaggtgaaaacaatttcagtggatggaaataaggctaaacttgcaatatgggttactttgcatcagcagactgcaaactttttcttaaagagccagataggaaatagtccaatcctgaagtgggccatgtggcaatacgatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtga

SEQ ID NO: 25202 - DNA, 1718 bp, Homo sapiens
actctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcagatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtccttt

SEQ ID NO: 25203 - DNA, 2379 bp, Homo sapiens
gaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacagatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcagatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccct

SEQ ID NO: 25204 - DNA, 1198 bp, Homo sapiens
gggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatagaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaatatcaaa

SEQ ID NO: 25205 - DNA, 1003 bp, Homo sapiens
atgtcttgtttacatcctaccagtgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatagaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagt

SEQ ID NO: 25206 - DNA, 907 bp, Homo sapiens
tttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatagagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttc

SEQ ID NO: 25207 - DNA, 1333 bp, Homo sapiens
tttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaatatcaaa

SEQ ID NO: 25208 - DNA, 2447 bp, Homo sapiens
attttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaatatcaaactgtatggtgataagtattgttttgattcttatggttaaagggaaatagagccttgcattatattcaacacagccatttgtgtgtgcacaatgcaaactaaggtattctagacctatcttagagcagcatccagtatttgctttctagataatatgcccaataacatgacctagaggggcttctgtgctgtgtagggatttaaccaacttcagtggttcagggagctcaaactatatgtaaaacaagtttagaatgtatgctatctagcccgttatctctgatccttctctaaaaccatttgaaatagcttcattgatcaacatttcataaatgcatctgtggtagaggtagaaagcagcacctttcctaattggcaaatgatcagactaatgtgtgctaatgtttttcttccatgctttcagtcagattcaactattttatcctccacagttgcttaacttggtgttggaggagggtttaagcattaagataggaagcaggaaatttgattgctctaaatttagaaattatatccctaaaaattaaaacatgaatactgggtggtaatgataattgaggcaaatgtatttattttggtgacattttgcatatatgaagattttctgaaataggaccttcaagatcctagggggttttgtttggtttttaattgtgaggaataaaaaatcttctgcccacactggcattttaaggtgactgaggtcaaacgttgtttccttaggttgaaatagcagccaaaacattcttcacgcaggggcttgggatatggctgctggcaacacattttgttgtgggctccttaatttaatgataaaatttaagctaaacacaagccaaaaatgaataggtttttttaatttttatttttcactaaacaggcaattgaaatacatggtacaaaaataagtggtaagataattgtaaaatgaaatggacagaatattcaattttccatctatgaaaatttcacaataaaaatcatagtttactttgt

SEQ ID NO: 25209 - DNA, 2254 bp, Homo sapiens
ttttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaatatcaaactgtatggtgataagtattgttttgattcttatggttaaagggaaatagagccttgcattatattcaacacagccatttgtgtgtgcacaatgcaaactaaggtattctagacctatcttagagcagcatccagtatttgctttctagataatatgcccaataacatgacctagaggggcttctgtgctgtgtagggatttaaccaacttcagtggttcagggagctcaaactatatgtaaaacaagtttagaatgtatgctatctagcccgttatctctgatccttctctaaaaccatttgaaatagcttcattgatcaacatttcataaatgcatctgtggtagaggtagaaagcagcacctttcctaattggcaaatgatcagactaatgtgtgctaatgtttttcttccatgctttcagtcagattcaactattttatcctccacagttgcttaacttggtgttggaggagggtttaagcattaagataggaagcaggaaatttgattgctctaaatttagaaattatatccctaaaaattaaaacatgaatactgggtggtaatgataattgaggcaaatgtatttattttggtgacattttgcatatatgaagattttctgaaataggaccttcaagatcctagggggttttgtttggtttttaattgtgaggaataaaaaatcttctgcccacactggcattttaaggtgactgaggtcaaacgttgtttccttaggttgaaatagcagccaaaacattcttcacgcaggggcttgggatatggctgctggcaacacattttgttgtgggctccttaatttaatgataaaatttaagctaaacacaagccaaaaatgaataggtttttttaatttttatttttcactaaacaggcaattgaaatacatggtacaaaaataagtggtaagataattgtaaaatgaaatggacagaatattcaattttccatctatgaaaatttcacaataaaaatcatagtttactttgt

SEQ ID NO: 25210 - DNA, 2007 bp, Homo sapiens
ccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaa

SEQ ID NO: 25211 - DNA, 1903 bp, Homo sapiens
ggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaagg

SEQ ID NO: 25212 - DNA, 1038 bp, Homo sapiens
cgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaagga

SEQ ID NO: 25213 - DNA, 6180 bp, Homo sapiens
gagacgccattagagggaggcagagagggatcgttcttcgcttttcctccggtgcctgacgtggtgggctggggcccttcattctcggactttccctcagcccttccaggcctcgcccgaggagggcgtggggacagcgcccgggtcggcggggccggggcggtgggggctgagccggccgtggctgtgaaggcgctgccgcggctgtcgggagggcggcgcgacactcgggctcgggcggccgggaagcgacgggatggctgcggccggcggcggcggcggcggggcggcggcggcgggccgagcctactcgttcaaggtggtgctgctgggggaaggctgcgtggggaagacgtcgctggtgctgcgctactgcgagaacaagtttaacgacaagcacatcaccactctgcaggcatcattcttaacaaagaagttaaatattggtgggaaaagagtaaaccttgccatatgggatacggcaggtcaagagagattccatgcattgggtccaatttactacagagattcaaatggagcgattttagtttatgacataacagatgaagattcttttcagaaggtaaaaaactgggtcaaagaattacggaaaatgttgggaaatgaaatctgtttatgtatagttggtaataaaatagacttggaaaaggagagacatgtttccattcaagaagcagagtcgtatgcagaatctgtgggagcaaaacattatcatacttcagccaaacagaacaaaggaattgaggaactctttcttgacctttgtaaaaggatgatagaaacagcacaagtggatgagagagcaaaaggcaatggctctagtcagccgggaactgcaaggcgaggtgtacagattattgatgatgaacctcaagcccagaccagtggtggagggtgctgttcttctggataactgttcacgcctaagaaattaaaagacagaacaaaactgtggatcattgccctcaacatgaagactgccatattccaagtcacattattttaccaatggaattatagaattaacagtattttaaattacgtttataacactgcagagaccttaagtgctaaacttagtggagtttgtgaccagagaattggcattttctacaaatgtttttttttgttttttttttgtttttttttgtttttttttgagacggagtctcgctctgtcacccaggctggagtgcactggcttgatctcggctcactgcaagctccacctcccaggttcacgccattctcctgcctcagcctcccgagtagctgggactataggcgcccaccacgacgcccggctaattttttgtatttttagtagagacggggtttcaccaggttagccaggatggtctcgatctcctgaccttgtgatccgcccgcctcggcctcccaaagtgctgggattacaggcgtgagccaccgtgcccggcctacaaatgttaacaaagcaattaccaatggcctttttacatattttttctttaatgaggaataatatgcatgtagaaaagacctacttaaagtcttcatttatattctttcaaatcaaatctttatttaataacttatatatgttgttggaatggttacatttttgcagccctttgtattttgtggtagttgaaattgtatcacttctaaacagcaaactgtttttgtttttaattagcagatatctgaagtactatttttgcagggtttgcacaggcccgtaactgtctactactttgatataatctgtatacatcctgtatgctgagctggtaaaatacattgtaaattacatattaaatattttatctgcttttacaagcgcaaggtgcaaaaatatatacaatagtctcattgatgactgtaaagtgaattaacatttggtgattatgcctagcttttttgactaatataaagatcatagctccccttcacttctgtcttaacttgaacatggcgtgtttaaattttcatacatactttacttgaattattgctgttgtcacatatttttgcctctgtgagttcatctgatgattgagcagtagcatttgccttttgggttttttgtttgttattatagaagagatgacttctgctgattttgctttagaatggttaccttagaagaatttgggtggctcatgttgaatttcacttctgcaatagctttcattttctcataggctttataagagatgggttcagtggtatgagcagaggaagagatcccagatagtagccagttaaccaagactcattcatatagcacgtagtttatgttcctgaggcagcacttttagatcctttgtgagcaagttctatttgttcattgcttgccagagatgaacacagaatgttctgtttcattttacaagaactatcctgagtttctgtggatggaaacattacatgtaatgcagatatagtgaacactggaaagatttattaaagaattatatttgtgtatactttataaattagtccctcattagatttttttttcttaagcataagactgaacttaaatgtgttaattttagtagaatcaggcactgctcgcagaaggaacacagattgtagagattaacataaattgttcttgttctaatatatatattttttcatttctgtcgtgcttggaaaactagtaaatattatgtctaagataaaatggaatggcccctggatttacttcttataagaagcagtagtatgtaataaagctattagcatgagcaattaagaggctataaagagattatagttacaaaagaaatactgccatatttttaagttaataacttaaaccttctcaaatgggttaaaagttgaatgaattgacaccctgatgttatgatgttggaattttaacttaaactgggaggcattctgtgagccttcactttaccttctttaattattgtccttgctaaactcaacacagacttttctgttatgtgtttttgaggaagttggggtgggaagagtcagggagataagctaaaattgtcttcttttatggggtaattgtactctgtagtctcttggtttcctgtgaagttagtatttatgtgggggtgggggaaggtagcaagaatcatgggtatcacggtactttgtttttgacctcctggctctttcagacagagtgaagaaagcttttccattcttactgttgtagaagtagataggaaataagcttttctcattacagtgaaatatgttttaaaaactagagtagctgggcacagaggcatgcatttgtagggccagctacttgggagagtgaggcaggaggatcacttgaggccaggatttcaaatccagcctaggtaacactgagacctccatctcgtaaaaggcacaaaaactagttagagatgaaattgagctttattttaaaaaaacgttctaaagcctgataattggagagctatacttcagcttttcatcctactttaatgaaacagctagataggaacctctgctccagaattgccagataattattggtgggtcataactattcttcatattttttttttcttttttctcctttggtttctgtgttatctttcttaacctcacgtatttctttatcctttttagtgggggcctgtaattgaggctaattcaatagcaacaatagacaacatgatatggctgctgtcactttgaaacccaaaaggtctttgggtaggaatagagtaatgaaagaggaccagtcaacttcagtatatatacaaaggaaagacaaagagatgataaaccaaggctgaggaaatttttctgatgctttcttcatttctctaatataccttttgcattctttttctgataattgtgctattaggcagaagacacaagttaccacgttgtgtattaaaagcagtaggtaggttgtgccagtattttttcagccagtaagcatatacagttaacttatataattaaaaattggtttaagatagtgattaaaaatacctgaatattatgttaaaagtatacaatcattgtttctgtaatgatgatgggtattctgcttcttgtttttcattgtaattacaggggaagattgtttttgaaaatgtatattgccatgcttttggggtaagcagtaatgtgaaaagaaaaaagcattatgttattgtatgaaatataagtgttcagatttgttttgtctggggtgttgcctaagaataccctaaagctatggctgttactgcattgaaatcttttttttttttaatagtagccatatgttattagtggagtactttatatttgacattaaagtgaagaagaagagtagtacttcacttttaggtttttagtagtgaaagataaaattggaaaaatagggaaagagcatagggaggaatagaatggaagtcaagtaaataaaaaactacaacctgacagttttttaaatcactttgaaaagtacattacttttatcaaagagtttctaattaaggcaaactatgcattatgccaaatattaagaacattttaaaaatggattgtgatactgtttatttctttaattatataatttgcaattttctgtattataagtgctaccaggattctagatagttgatcttacatattcagatagtatagtttactcttataattacccgttacgttatctctaaaagtagtttgatctgtgcctttaacttttagaattcatcttttgacttgtttgccactgtagagttttcagttttctctgtagattcagtgtgacaaagagggaatacataatttgtgaccatttaagatgctgatattttctggaaaaggatatagatagtagtagtgacccgcaggagcctcacaataatgtctaaagatataaactgagtagatccctaagtactcttctctaaattataaaatgcattacctaggctttaatagttaaaagctggaatttattgaaccgcatctacttgatttcataatatgcattgattttagtatgttgctgttctgttatctgtaatcaactataacagagtaatatatttggtgttctggaccaaaattcgtgctacacatatgtctgatggcctttaccttttcaagaaaacagttgcaattttgagcaaaattttcctagttgtaatattttaatagtgttatgtattggaaaaaatttagaaatactcctaagagttttcaatttcaagcagaaatgcttctcttctaaataaataccacttaattgatagacctttagcagttcttgtgctatctaggatttatacatttttgcttttctggaaaactgctttggcgcattaacctttctactgcaacattttctcttcagtagatatatgagtaaacatgatgagttaatgttacacagcatacccagttaggtctcttattcttaaagcatctttctttagaagtctgcacatattttcaaatgcatcatattaaaggcacaagtcaagaggaggtggagttgcctacttcagtggcctttattcccactataccagttctcagtcttgattttgatactttctggcaactgtatcatctcttcactatcacgtattttaagaaaaagctaaggtgatttctttacatttgaacatgtgtagatcaatgagagaatggtgagggatagcaaggataaagtataatgttgaaaagtagaaagaagtggtatctgctaaactctagctttagtagcaagctattttaaggaaatcattgtatgtggtacttcctagaaatatgaaagttcctcattttgtatttaattatgtaagaaaatgttctaggaaaagaataaaaaacatatattgtcaaagtgccctttggtagtgctcccaaatggtagtaactattggtctctagtatatactcctcaaatatctttttgctatgtattaatatatctatatgtttacatatagaaatacatagtgttgtgggttttaaattttcacataaattgtgtcttacccatgtgttttgccatttgccttttctcttgccaacgtgtctaggagctctttggtaaatacagactttttcattttatttcctcccacatttctatggatgtgtcttgcctttttcttttttttttctttctttttttcttttttaaaatagcctctgact

SEQ ID NO: 25214 - DNA, 8670 bp, Homo sapiens
cgaggtgggcggggaggtcaggtgacgcggccggcgtcccaagatggcggcggcggcggctcccggaaggccgcggcggcgtcccggctgctaaggcgggccccacgcggctggcagcggacaggccggacctacggccggaggacgggcggcagccgcctctgcgcggaccggggctgggccgtgcggcggcagcggcgccaggggatgctcttgctgggcctggcctctcccttctcaacttagggcggcggcgggcccgcgcccctggctcccgggccatggcgctgagggagctcaaagtgtgtctgctcggggatacaggtgtaggtaaatcgagtattgtgtggcggtttgtggaagacagttttgatccaaacatcaacccaacaataggggcatcttttatgaccaagactgtccagtaccaaaatgagctacataaattcctaatctgggatacagctggacaagaacgatttcgtgccttagcaccaatgtactatcgagggtcggctgcagctataatcgtttatgatatcacaaaagaagagacattttcaacattaaagaattgggtgaaagagcttcgacagcatggcccacctaatattgtagttgccattgcaggaaataaatgtgatcttatcgatgtaagagaagtcatggagagagatgcaaaggactacgccgactctattcatgcaatttttgtagagaccagcgcaaaaaacgcgataaacataaatgaactctttatagaaattagtcgaagaattccatccactgacgccaacctgccatctggcggtaagggcttcaaactccgaagacagccttcagagccaaagcggagctgctgctgaccgaacctcagcctctcagacttgatgatgaagtaggtggtcctgaaagttaacaggagggctggggtccctgccaccagttttcacctagccagtcttgagtcttctccgtgcaaaaaggattcacagaaatggaccagttctgttctccaaagactgcagcaatgatatttcagtctgtgaacttctattatgtaaagaatctctagtgtacaaagggactacatcgttggcttttgaccttgctgaaaaggaacatataattgtatggatggtaggattaagttgttgagtagttttgtaatcaagattttatgtaacatttgtaaagggaaaattagcacttttgtggttcttaagggaaaagaaacagaccttgtggagattataatttccttggtttctgttaccactgttagagggagttgtatcatttaacatatagtaggatagtttaagtgtagggaggacaattattgtctgaagctaaaatgggttatttataggactgatggaaatgatttcatctctgccatctctaaagcacttttcattgaacatgttagcctaggatacgtacagtaaattaacaatgatagcagcagatgcctagctcatcctgggtttgcttctgaccttgtcatgtgtgtgccaccaaacacgttattggcacctttttaaataagctctcatgatcaagatggtgatggtagagaagctgcccggaataaactgaatttcatatgttctaaaatgactagcaatggtttaaaaaggaagaagagtggaagtgaagaaggtggtataaatgctgtcaatttttttttaacccaagtattttggtggggaaaagcaagtatctattgcttagcatatgtaaagttgtagtctatatttatggggccattgcttaaagattataaattatgtaaatacattaataaattctaagtttcatttgacattccattgaatctcgcacccagtcttgcgtatgcctgcccagttttcagcctcttaacgggagactcaagcacattggtattgtataaaggtatagagcacttagcttacaatctttaaaggtttctctgccttcccttctacccacccgcctcccaccagatcccatctggaaatcataataaagacatatgccactttgacaaacctgactagtccttactagcctgagggtaaaagattaagctccaacctcaagtcatttacctggtcttggtaataagtttcttttagcttgtacagcatcctcagaccaactgaggagctttccttgttaacaatttagcttatctttctgtttcctttatttttcccctgcctctgttagtggttaacactcttttccctcagggagcctaatgaggtttttaatatcatctaaaaataaagcattgaagtgaagttggtgaaaatttgttcctggtctaatttggcacccttccaacctgagtattgtaggggaaggaaatttacaagatttaataggaaatgaaacagcttgaatttcaaactaaattgtattttcagagctatcctgaaactgaacagctgaaactttaaaaaataattggtattattttgtgccccccacttaatatggatagattttaatgggaaaattataattcagattaaataaaaaacaattcccttttccctgttgtatatcttaagcatttggaattttttttatcttctgaaatcatataaaaagaatgtcattagtaaaaattctaacttcgttttgtttaaaagacatgtggatgctccatgcccctaggattttgcttcctccccggtgctaaattagcaagctcctagagaagccatgtgattcccagagccaggcgctttacacctaaagtagtttgactttcttctgtatacatccagatggatcccaggcatccgggcaccaccctggtgtgtccctagaattcccactgctgggcctctatctccatgacaacaaaataaaaacagaggttgcttgactcattaccaaagaggcaaagcatgtgcgaccctttctgtcttattttaccaaaagatggtgcaaatctatgaccttcacattttttccaccacacccaccagtagctgttggtgattgcatggtgtctcggtgcatggggaaaggcaaggtcttctgagctcatcttaactggtgaggcatctggatgtgtctgatcttactgtgatgttttactgtaccgagcccaatgtgggtccatctcatcagccctttgctgatttcatgatttctcaccctccctcccatatgtagggtgtgattctgttttattatagccacatgttttattaacagaatgagtgatatgaagcttgtacttatgcatttctcgggcctcttccctcattttcatcagtctgtctaagaacttgactcggcactgtttctcgtgtaatatccttctaatgcttagcaacaacaacaaaaaattgctctctcagatccataatccatactcagtgaaagcagggaaaaaatattttcacttattttatttgcttctaaaatgcaaagatgaatactaaagtcagaagcagtgtttcattttgaacacattttggattattaagctgactaagcaatgatctaatacacatttcatattttctttataataatttcttatggagaagaggctatatttcaaaggaattgagacatactcccatctataaacatgtttggttttcttacgatacagggccatttttttaaaactctcaggactgaacagaagagaaaaattattaattagctgctactgtatgttgattcttttcggagaaattgaaataagctctttgcaggcgtccaatcctagaaaccaatggtctccagaactctcacacaagtgtttttctgattctatgataactaattaaccatcatctggtgattaaaagaacataaagtaagattatgattaagtgtccatcacctgcctgtcagccgtggtcagaataagttttacacgaagcaggtgaaagatttagttcttttcaaagtaacttattttcttgtgacccgtttatgatgttgtttgaagtccctgtttcccattgtgtacgcactttctggatgtctggaaggatcgggacttttgtgtgagaggcttgagcgcctcctctatgtgggctggtgtccttcttgaagttgtcaattcctcttattcttaaatatctaaagggaaaggaaaccaactttaatttcagaacttctctttacgtcttgtatgtatttcttttctgttctcaaggaggaaaattggtctaggaagccttctaaattaaactctgggaaatatagtaatgaaaatatcctttagctaactttcctgtaactgtcaaaccaaaatgtcagtatttttagggcattgtgttaaaataagcagtttagattccgacgacactgcactaattggcatgtcagcctccagctcagaaaggcatttgctcatggttacaggcatcttttagattctaagagtgagttacagaattctttttggtactttcacttattctttcagaatacatcaaggatgtgatttatgggcccttaagagtataagatataggtgcacagtatgttacttaagtaacggatgagcccccctaaacatccacgtgtctctgcaggaacctgtgtaagtattgtgaaaacccttttcttccagggaaaaattattggaaattccttaactgagctatacttggtacttgctctagaacatttgggaaatgacaaactcaggctggctctcctctctaacctcactgggctataaatgttccttctaactctgtaatgaaagttcagtgacaaactagatagtgaacctgtgaaagtcattatttacatttgctttaaagggacagttttaccgttcaacttcaagagtttttctacctctttaacagttaatattttttaaaggaagaaatggaatgtaccttcaggggtcaagctgttaactgtatacctgcctctagttagcttggtttatcaaaaggatttttaaatgattcaaggtaatgtttaggatatttgttttaactcctgctgtgctgtgatttaaaaaaaaatagtctaagaaacaaatttatccatgagataaacatcatattttatagttttagaaaaaagggttgggggtggaatttagcctagaacttaaagaaacaacctctgcgaatttctcttgacagcggagttgcttgtcttgacttctaataatataaatccaggcagtttgattatccgatttgcaagaaactttaatggaattctggggcatttgtcctgttttatgtgcaaatgaaagtctaaaaaatatgaggaagatattacatttttcaggagcctccattttttcagtctaagagaatgataagtgagaggcctattgtgatgaagttgcattggacataatgtgggaagtgaataaatagaaccaagaatcttcatctatctctgttggtctttcaggattctcttagcatataggaaaatgatttaccttccagatctcgaaggacttccaatagcatagatcaggtttaatttgatggtctataccatcagaaataactaatatctgttttctttccttttagagtataatcaattatggataggccagaatatttttggcttcaaaacaaaaggattcataagcttaaaaaaacaaaaatcccaaaccttccatctatcccttttattacgttgaacattttagatagtaagattaagatgtatcattagtatatggtgaaattaaaaccgtggtgtctaacagatttaacaaaaagtgtttaatttactgcaagttcatttttagatctgtatggtgcccagtactccacaaaatgcatcataattgaaacaacaaaattattttcatgagcaagaattcaagtatcaaggcctatcagccaattaaaagccgtaagatagtaatgattttttttctttttttttttttttctttttttagatggagtctcactctgtcgcccaggctggtatgcagtggcgcgatctcagctcactgcaacctgtctcctgggttcaagcagttctcctgcctcagcctcctgagtagctgggatgacaggcgtgcaccaccatacccagctaatttttgtatttttagtagagatggggtttcaccatgtttgccaggctggtctcgaactcctgacctcaggtgatctgcttgcctcggcttcgcaacattctgggattacagacgtgagccaccgcgcccaaccagtaacgatttttttaaagggcctttcttaattgacagttttaagctgtagacattaatattataacaaacaaaacatgccagttttactgattccgctttttgcttgattcaggaacttttcattgtttggggaagcttttgaatgcagtactgtggaggaaatcatccttaaaatagcatttcacacatagggccaaaattgaaattgtcaaggaaacccctcagcatctaacgtcatcttgtagaagagctgggcatacctcttcctctaggccaattcagaggccactggccacccaagtagagtggggcccactggcatgagtagtccctgtgcccatgcccatggtggtgcttgactttgctttggggcttaatcctagtatcatttggccattaatttttaattaagtttatacttgaataatcagttttactcctgaaaaattttgaagccagcactgactttgtttatattcacttaccttgtatatgaacttatgacattagagtttgtgaaactgtcttaacgtggctcatacacgtgatgtcagagggactggtcagttctttacagggtgaattaatcggcagctggctagtcagagcaactgatgggtggcttttttttctttttttttttgagacggagtctcgctctgtcacccaggctggagtgtaagggcgcgatctcggctcactgcaacctccgcctcccaggttcaagcaattctcctgcctcagccacctgaatagctaggattacaggcgcccgcccccacacccggctaatattttttgtatttttagtagagacagggtttcaccgtgttgatcaggctggtctcgaactcctgacctcacgatccgcccgcctcggcctcccaaagtgctgggattacaggcgtgagtggtggccctatttttaaaccattcgttacgctgtgtagacagagctttattgccctggaaaagattttttttttaactctcatgcagttcagtctttccatcatttcactttgtgagtcactcacataattgtcaatcattcctctgaccttcttaagaatttacaccttaccgtctctgtgattgaagcagacttctcgctttatttcccttaggctcatttttctgtgggctctcccttaaagacacatggccacagacacctccttcgcatatgtaatctgccttcccctgcggccttccgtggtcacagcaacagggactgctcaccccctccagctggggcttttctaacaagcacagtcagaaatgcgcaggcctggggttggggatgaacagaagttgattagtgggcacagaaatacagttagatagaaggaatagttccagcattcgatattacagtagggagactgcatttaacaataattgattgtatatttgaaaacagctagaagaataagaatattcccaacacaaagaaaagataagcgaggtgaaggaaatcccagttaccctcattcagtccattacacattcgatacaggtatcaaaatatcataggcacctcaaagacatgtacaactcttaatttaacatttttgaaagaaaaaaaaaccggccagagcattaaaacaaataaaataagaaacacagaggccagtgttaggtgaagaactccgctgcttcagaaagagaatagcagcgctcgcttaccgtgggaacacggccagttaacaaaatgggttttggttttttgttttgttttgttttaccattggtaataagatagttaacataagtggtcagaacttcgctgaatttgtaataaagcatttgttaagcgtgtaaaagtccaaattaaaagtcttgaagaaaaacagctatggcaatgagcctagacatttttcaaaaaaaaaagctaagccgtcctaccagcaatctctctttctcctaagaatgtcatgccttctcaagacctgatgaaaggaataagatatttgtgcctttttataaaagcatctattacgaaagtaaaattcagttgcttacagttttggccgctttgtagcactattataaacagcccaaatttatggccttggacttactgcatgacacatggcctggttacctgtcatggaatgctgcagtggtggtttgccaagcttctgtggatgtttgaagactttatttttgcagtcttaaccttgggctggacctaagtgtatgtaaaccatatgatgcctgtattgtttatagatgctgacaaaagaaaactagaccttttgttttttgttgtaagatttttgttttcatgcctatgctcatagtagatagtttgcaaatgaaagttgatttgccatacttttaaataatattgttttagcttgaatattctataatacacttttatagagtataacatgctaaatcactgttttgttgtaagaagggtgtaaacattttgttaataaaatgctatgtttacaaatata

SEQ ID NO: 25215 - DNA, 2986 bp, Homo sapiens
atgaggggagtcgagactcccgcgccccaccacccccggcggagctgctgctgagccactcaatctgagccctggctactaataaagttcgtttaaaaatcataatcattcttaagagagcgaaagagggtgcgaactagccgctcggccccgcagggagagctggcgcgtcgggaggagacagcggcggcagcggttgcgccgcgaccaggaggagccggtggcgccgggcggcgggtccgcggccggtgggggacggtgagtagcggctcgcgctgcggtgcagcggcgctgcactcactcgccctctccaggggctgggggttcgtccggctccactggggaagactcagcttctccccggggtcccgggttgtgccttactctccggagtgggcaggggtatcgagggcaggggcctcccggcccggctcccccatcccccggttcggaccgccgagcgccggctctcccctccctgagcaccgatcccaagttccagctagagaaggtgggcggcagcgccagcccggcgccccctcccagctcccagcgatttgagagggaagatctgatctcctagaattagagttggtacagaaaccatttcagctccaaaaatgttggaggaagatatggaagtcgccataaagatggtggttgtagggaatggagcagttggaaaatcaagtatgattcagcgatattgcaaaggcatttttacaaaagactacaagaaaaccattggagttgattttttggagcgacaaattcaagttaatgatgaagatgtcagactaatgttatgggacactgcaggtcaggaggaatttgatgcaattacaaaggcctactatcgaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaatgaggaagctgaggcactggcaaaaaggttaaagttaagattctacagaacatcagtgaaagaagatctaaatgtgaatgaagtttttaagtatttggctgaaaaataccttcagaaactcaaacaacaaatagctgaggatccagaactaacgcattcaagtagtaacaagattggtgtctttaatacatctggtggaagtcactccggtcagaattcaggtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcagtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattgaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcacttgggacagtagctttccagctaagataattgcgtgaactctgttaaaactgattatcactcatcaatggctttatttttaacctataaataacccctttcaatatacctggtttttacagcattgcaaaatctgtaaaaataacttttattggaaaatgtcatgaagtcatttttcattatttgtactaaacaatgttttatgtactccttttgtgttttatcttttgtttttccatctgtactcccctcatcctcctaatgttgagaaaatcaaatttcctgggtgtgtccttgttaagtgatcaaaagtaaatgttctctttgccattttagatgg

SEQ ID NO: 25216 - DNA, 1530 bp, Homo sapiens
tgacactggttgctacagaattaactttactcggagatccgaggagccatcggcagttcccaggagtaagaacctgagagcgtgtgagaatttgagagggaagatctgatctcctagaattagagttggtacagaaaccatttcagctccaaaaatgttggaggaagatatggaagtcgccataaagatggtggttgtagggaatggagcagttggaaaatcaagtatgattcagcgatattgcaaaggcatttttacaaaagactacaagaaaaccattggagttgattttttggagcgacaaattcaagttaatgatgaagatgtcagactaatgttatgggacactgcaggtcaggaggaatttgatgcaattacaaaggcctactatcgaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaatgaggaagctgaggcactggcaaaaaggttaaagttaagattctacagaacatcagtgaaagaagatctaaatgtgaatgaagtttttaagtatttggctgaaaaataccttcagaaactcaaacaacaaatagctgaggatccagaactaacgcattcaagtagtaacaagattggtgtctttaatacatctggtggaagtcactccggtcagaattcaggtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcagtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattgaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaac

SEQ ID NO: 25217 - DNA, 1311 bp, Homo sapiens
tcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacaatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgc

SEQ ID NO: 25218 - DNA, 1236 bp, Homo sapiens
ccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacaatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgcatcaca

SEQ ID NO: 25219 - DNA, 563 bp, Homo sapiens
gaccttgcggccccgccccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcagg

SEQ ID NO: 25220 - DNA, 1100 bp, Homo sapiens
ctcagcttccgtcctctctgcttccttacagcacccccacctgccagagctgatcctccctaggccctgcctaaccttgagttggcccccaatccctctggctgcagaagtccccttacccccaatgagaggaggggcaggaccagatcttttgagagctgagggttgagggcattgagccaacacacagatttgtcgcctctgtccccgaagacacctgcaccctccatgcggagccaagatggggaatggaactgaggaagattataactttgtcttcaaggtggtgctgatcggcgaatcaggtgtggggaagaccaatctactctcccgattcacgcgcaatgagttcagccacgacagccgcaccaccatcggggttgagttctccacccgcactgtgatgttgggcaccgctgctgtcaaggctcagatctgggacacagctggcctggagcggtaccgagccatcacctcggcgtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctgaaaacaatggactgctcttcctggagacctcagccctggactctaccaatgttgagctagcctttgagactgtcctgaaagaaatctttgcgaaggtgtccaagcagagacagaacagcatccggaccaatgccatcactctgggcagtgcccaggctggacaggagcctggccctggggagaagagggcctgttgcatcagcctctgaccttggccagcaccacctgcccccactggctttttggtgccccttgtccccacttcagccccaggacctttccttgccctttggttccagatatcagactgttccctgttcacagcaccctcagggtcttaaggtcttcatgccctatcacaaatacctcttttatctgtccacccctcacagactaggaccctcaaataaagctgttttatatcaa

SEQ ID NO: 25221 - DNA, 1650 bp, Homo sapiens
ggcgcgagccgggcgcccgggatgatgccgccgccgccgccgccgccgccgccgccgccaggggaagggttcgggtccgggtcgggctcggcgggcgcggggtgcgggacggcccagggcacggcggctgcagcgggagcacactgagcgcccgcccgccatgtccaggaagaagacccccaagagcaaaggggccagcacccccgctgcctccacgctgcccaccgccaacggggcccgaccggcgcgctccgggactgcgctttccggccccgacgcgccgcccaacgggcccttgcagcccggccggccctcgcttggcggcggtgtcgacttctacgacgtcgccttcaaggtcatgctggtgggggactcgggtgtggggaagacctgtctgctggtgcgattcaaggatggtgctttcctggcggggaccttcatctccaccgtaggcattgacttccggaacaaagttctggacgtggatggtgtgaaggtgaagctgcagatgtgggacacagctggtcaggagcggttccgcagtgttacccatgcctactaccgggatgctcatgctctgctgctgctctacgatgtcaccaacaaggcctcctttgacaacatccaggcctggctgaccgagatccacgagtacgcccagcacgacgtggcgctcatgctgctggggaacaaggtggactctgcccatgagcgtgtggtgaagagggaggacggggagaagctggccaaggagtatggactgcccttcatggagaccagcgccaagacgggcctcaacgtggacttggccttcacagccatagcaaaggagttgaagcagcgctccatgaaggctcccagcgagccgcgcttccggctgcatgattacgttaagagggagggtcgaggggcctcctgctgccgcccttgaacctggctgagctcagtcctctggaggaagccgtccagtccctagaaggctggacagagggtctccaggcccttctgactttgttgcccagtggccaacgcccgagtgtctgttttcaggagccccaggtcaagccttgtcccttcctcctcccagcaacagtcccaacaagcaggcttctgagagcccgtggccgcacactggccgccacggaaaagcagtcttctgcacgggacggggagcggcaagtggacagactttgccacggtgctctgctgccccctcctgggcacgtccaggtgagggagggctggggctggcaccacgcacagtgcctaaccctagaaaagccatgtcttcagccgcacatgctcaggcagctaagggaggacgcctgcccacgcctgggacagaaggcttcactgctaatcacatcgtgcatctgtgtgtcctgggagctgcctgctcccggcccaccctctaggaggctctggctcaaacagcaatagggtcttcctcactgaccttggaggatgcctgtggccttgtgataaaatgtgggaaatcacagaaaacaccagaaacaacaactgccagcccggcctggccacaggtgaggtctgtgatttccgagcacgctccaccttgcactcaacttggccttttgattgcacaagcctttgttttcagtcctagtgaataaagttgtgttttctgga

SEQ ID NO: 25222 - DNA, 944 bp, Homo sapiens
gtgtgtttgccaagccagggctggagcttcctggacccgcctaccctggaggggatggagcagtgaagggcaccgggccaagcgctaggcatctggggctaaggagacagaagcccgcggtgcccgtccatgcgggccctctgccccagcacccacatctcaggacaccccttcctcccaggaagaagacccccaagagcaaaggggccagcacccccgctgcctccacgctgcccaccgccaacggggcccgaccggcgcgctccgggactgcgctttccggccccgacgcgccgcccaacgggcccttgcagcccggccggccctcgcttggcggcggtgtcgacttctacgacgtcgccttcaaggtcatgctggtgggggactcgggtgtggggaagacctgtctgctggtgcgattcaaggatggtgctttcctggcggggaccttcatctccaccgtaggcattgacttccggaacaaagttctggacgtggatggtgtgaaggtgaagctgcagatgtgggacacagctggtcaggagcggttccgcagtgttacccatgcctactaccgggatgctcatgctctgctgctgctctacgatgtcaccaacaaggcctcctttgacaacatccaggcctggctgaccgagatccacgagtacgcccagcacgacgtggcgctcatgctgctggggaacaaggtggactctgcccatgagcgtgtggtgaagagggaggacggggagaagctggccaaggagtatggactgcccttcatggagaccagcgccaagacgggcctcaacgtggacttggccttcacagccatagcaaaggagttgaagcagcgctccatgaaggctcccagcgagccgcgcttccggctgcatgattacgttaagagggagggtcgaggggcctcctgctgccgcccttga

SEQ ID NO: 25223 - DNA, 2799 bp, Homo sapiens
cgccaacgacccaaaaaaggccggcggcgggtggacgcggcgcgcgaggacccgagccaggcggggacaggacggcggggcgagccagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctact

SEQ ID NO: 25224 - DNA, 2790 bp, Homo sapiens
gttttgaaagttgatggagcgaactgcttttccaaagactcttttgaaaaactttttaagtaggccattctgactttaacatttctctttgtcttaacattagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctact

SEQ ID NO: 25225 - DNA, 3459 bp, Homo sapiens
gatgcctgttttgaaagttgatggagcgaactgcttttccaaagactcttttgaaaaactttttaagtaggccattctgactttaacatttctctttgtcttaacattagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaaaaaaaaaaaaaaaaaaaaatgggctgggcgtggtggtgggcacctgtagtcccagctactcaggaggctgaggcaggagaatggcgtgaacctgggaggcggagcttgcagtgagccgagattgcgccactgcactccagcctgggcgacagaggagactctgtctcaaaaaaaaaaaaaaaaaaaaagagcagggtcataatcacacagcagtgccttatatagttgccataagacttcagtgcagtacaacataattttacagctacatatcagggcatattctatatggtgtatttgtgttagaataacacattaaatgtctttaaacataaaaataagaatgtttgcatgtttcagttttcaagaaccaaatgagtaattagctatagattccactggccttaaacatacaattaagtgtatacatgatatagtgcacacacaaaagccacctttaattattgaaataacctgtattctttttggaaatcatttaagtttggtattgaagtactatattttttgtgcatcaatgtatttttctatttacaagcctatgtaaaagtgaagtgtatcttcagtgaaccatgtgccaattaagctgtaataaaaaagtggtctagtctgtcaaa

SEQ ID NO: 25226 - DNA, 1810 bp, Homo sapiens
gtgcgcgtagggggcggggccgcgcgcagagggcggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagggagtcctcttggtatatgatattacaaattatcaaagctttgagaatttagaagattggtatactgtggtgaagaaagtgagcgaggagtcagaaactcagccactggttgccttggtaggcaataaaattgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagcgtattgtcagggcagaaatagtgaagtacccggaagaagaaaatcaacataccacctctactcagagtagaatctgttcagtacagtagtgcagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccgaggacttctaggaacttgttttatcagtgaccatctctgtagttcagttaacactttactcccaacttgcttcatcattgctattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatttaaatta

SEQ ID NO: 25227 - DNA, 1715 bp, Homo sapiens
gtgcgcgtagggggcggggccgcgcgcagagggcggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagggagtcctcttggtatatgatattacaaattatcaaagctttgagaatttagaagattggtatactgtggtgaagaaagtgagcgaggagtcagaaactcagccactggttgccttggtaggcaataaaattgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccgaggacttctaggaacttgttttatcagtgaccatctctgtagttcagttaacactttactcccaacttgcttcatcattgctattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatttaaatta

SEQ ID NO: 25228 - DNA, 1787 bp, Homo sapiens
gtgcgcgtagggggcggggccgcgcgcagagggcggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagggagtcctcttggtatatgatattacaaattatcaaagctttgagaatttagaagattggtatactgtggtgaagaaagtgagcgaggagtcagaaactcagccactggttgccttggtaggcaataaaattgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagggccatttcattattttcatttcatcaactaatagagaataatcgagtgtgctttgtggctctaaaaataaagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccgaggacttctaggaacttgttttatcagtgaccatctctgtagttcagttaacactttactcccaacttgcttcatcattgctattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatttaaatt

SEQ ID NO: 25229 - DNA, 1551 bp, Homo sapiens
ggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagttgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccgaggacttctaggaacttgttttatcagtgaccatctctgtagttcagttaacactttactcccaacttgcttcatcattgctattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatttaaatta

SEQ ID NO: 25230 - DNA, 3848 bp, Homo sapiens
tggcggggcgcggccagcgtgcagggctgggccagcgtgcggggctcctcccctttcctccggcggcgccggcggccgcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactcaacatgtaacattcaaaattgtgatcttcataaagacattgttaccattcgtcttgcaaatttaagacaactgaatgaaaagccaattttttgaaagaatgtggcatataattagatatacaactgaaacaggatatacaactgcatacaatttgtttttaatgatattttaaaatagcctgttagcaggaaaatagtccctatttatctgctaatggtcaaaaagagttaggatataaatcgtaccaaaatgtttccaatcactcagaaaaactgattcatgtctggctttgcaacaccttaaacatttattctgtcatagatagtaaagccccatctcagtttatttagtcctgaggttggcagcatggggtttgactatatgagctaaaagatacacaaagagataacgctgtttcataataaacaggaattgactatacaaataggtaaaccagcatatctacctgtatttctcagagtttagatgtgtgctttatgtttacattaaaataaagcctaacgccacagta

SEQ ID NO: 25231 - DNA, 1058 bp, Homo sapiens
agaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttcta

SEQ ID NO: 25232 - DNA, 1612 bp, Homo sapiens
cggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcag

SEQ ID NO: 25233 - DNA, 1987 bp, Homo sapiens
agaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccgttctcttccacagccctgaggtcttacgaatttttctactttctttttgctgttgatgaattgtttcattattaaatatatgcatgtatc

SEQ ID NO: 25234 - DNA, 2928 bp, Homo sapiens
aagggggagaagaagaagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgctgaacatctggcttgaactttttttgtccttcctggaatagcttcagatcaataggcttaatgaaagaggtctttcttgctttggctgagagcagcctctttttaaagtgtgatgttttgcctttccacctaaagaccaggagagaatttgggcccttactgacctgtcctccttcagggacatgagcattccctatagattagggttcttcttatcctcctatacaaatttcttaaattgttaggatcaaagttgattatcacagtagttaaaaaataatttcatggcggggcgccatggctcatgcctgtaatcctagcactttgggaggccaaggtgggcagatcacctgaggtcaagagttcgagaccagcctgaccaacttggagaaatgccatctcaactgaaaatacaaaattagctgggtgtggtggtgcatgcctgtaatcccaggtactcgggaggccaaggcaggagaatcgcttgaacccaggaggtgaaggttacgctaagccaagatcacgccattgcactgcagcctgggcaacaagagcaaaactctgtctcaaataaataaataattttttttttctttttttttttttttttttggggggatggagtctcactctgtctccaggctggagtgcagtggcatgatcttggctcactgcaacctccactttccaggttcaagcagttctcctgcctcaacctcccgagtagctgggactacaggcatgtgccaccacacctggctcatttttgtatttttagtagagacagggtttcaccatgttggccaggatggtcttgatctcttgacctcgtgatccgcccaccttggcctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccgttctcttccacagccctgaggtcttacgaatttttctactttctttttgctgttgatgaattgtttcattattaaatatatgcatgtatcaaagcta

SEQ ID NO: 25235 - DNA, 559 bp, Homo sapiens
aagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacgtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgct

SEQ ID NO: 25236 - DNA, 4197 bp, Homo sapiens
cttcttcccggcagccttagcgccaggcccggcgctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactctttgatgatacacgggaagcagaaaaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaaa

SEQ ID NO: 25237 - DNA, 3717 bp, Homo sapiens
ggcgctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagaacaacttttaacagttccatgtgtgcacattataccttgaaaaaaagtgttcacaacagcgaagacttgaaaccaacccaaatgtccatcaatgacagactggattaagaaaatgtggcacatataaaccatggaatactatgcagccataaaaaaggatgagttcatgtcctttgtagggacatggatgaagctggaaaccatcattctcagcactcttaacacgggaacagaaaaccaaatgctgcatgttctcactcataagtggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactctttgatgatacacgggaagcagaaaaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcagttaaaataatcgatggggatgtgtagcccccccgtgtgaggatgacatcaccacatttctagtttcatggagctcaagatgtcttgtgtctgtgtggctagatggcctctgcttgctccccaggtgtgtcctggtagacaactgctcccaggagctggcatagaagcaaacctgcaggaaaagccaacccactccaggtgtgtggaagctgctggcaggaacccagcaaggatccagctgggttgtaatggaaacaatgcaaccaacaatccttgagcgagccgggatagatgtggcctcatcactgaagatttcatctgagacctctgcaaatatccaaattgtatatgctcttagagcagatcattttctcacaggttgtctaaccaaaggaaaggaaatcagcatatcaaagagatatctgcactcccatgttgattgcagcactgttcacaacagccaagatgtggaatcaaccagagtgtccattggcagatgaatggattaaaaatgtggtgcatgg

SEQ ID NO: 25238 - DNA, 4185 bp, Homo sapiens
gctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactctttgatgatacacgggaagcagaaaaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagaggctgactgaatcttctgatgaggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaaa

SEQ ID NO: 25239 - DNA, 7257 bp, Homo sapiens
ggtttctccgccttctgcttggctagagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctgaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaagctgcagcatcaggcaatgagaacatacaaccaccaccattagcttataagaaatggggtctacaagatattgacactattattgatcatgctagtgttggtattatgactctgtccccctttgatcaaatgaagactgcctccaatataggtggatttaatgcagcaattaaaaatagtccacctgccatgtctcagtatatcactgtagggtccaatccatttactggcttcttctatgctttagagggaagcacacaaccattattatcccatgttgcactagcagttgcaagtaaactcacttctgctttatttaatgctgccagtggttggcttggttggaaaagtaagcacgaagaagaagctgtccaaaagcaaaagccgaaggttgagccagctaccccattagctgtaagatttggacttccagattctagacgccatggtgaaagcatatgtctgtctccatgtaacacactggcagcagtaacagatgatttcggcagagttattttattggatgtagctagaggaattgcaatacgcatgtggaaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggctgctgtatcctggctataaaataatgggtttaaataatgttaccagtcagagttggcagccacagacttatcagatctgtctggttgatccagtgtctggaagtgtgaaaacagtgaacgttcccttccatttagcactgagtgataagaagagtgaacgagccaaggatatgcacctagtgaagaaactagcagccttactgaaaacaaaatctcccaatcttgatttggttgaaacagaaataaaggaattaattcttgatattaaataccctgcaaccaaaaaacaagctttggaaagcattttggcaagtgaacgtttaccattttcttgccttagaaacatcactcagactttaatggacactttaaaaagtcaagaacttgagtctgttgatgaaggattgctacagttttgtgccaataaactaaaactgctgcaactctatgagtctgtcagtcaattaaattcccttgattttcatttagacacaccattctctgataatgacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtagtttctttttttggaagtgtttgcatggagaaagctccactgaggatatgtgtcacactttggagtcggctggtcttagccctcagctgttgttgtctctgctcctgagtgtttggctttcaaaggaaaaggatattttggataaaccacagtcaatctgctgtcttcataccatgctgtccctcctgagcaagatgaaagtggccatcgatgagacctgggattctcagtctgtgtccccatggtggcagcagatgcgcacagcctgtattcagtctgagaacaatggagccgctctgttgtctgcgcatgttgggcattctgttgctgcacagatatcaaacaacatgacagagaaaaaattttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccagacttactgcatttagcctatgagcagtttccttgtagccttgagctcgatgtcttgcatgcacattgctgctgggagtacgttgttcagtggaataaagatccagaggaagcacgtttttttgttaggtcaatagaacacttgaagcaaatatttaatgcacatgttcaaaatggcattgcactgatgatgtggaatacgttcttagttaaaagattttctgctgctacatacttaatggataaggttggaaaatcaccaaaagataggttatgccgaagggatgtgggaatgagtgacacagcaatgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 25240 - DNA, 1393 bp, Homo sapiens
gtttcataatctgttggctcaaatctgctgctgccacaccctgtgcctctcagggtccctgggtcctgttgcagttatcatatgcctcacctttaacctaaatgactctgcgaagtggctgctatggaaggatttactgagtgcaaaatggattttcttccctgctctttggggcaaagctggctcagagattcttagctgcagggggaggggctggcaggcctgaaccgcagttggacttagcagccaggggttttctggttttcattaaaattctctggctgtcttttgggatagctccattggatatgactgtgcactggagccggttgtgctgttctctcagctgtacacacccatcaaatcacagtgcccctgaggacgagagaaaattgaagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgaggcacggagaagaaaaggaatcagcaactgccctgatgggccatgagatgctggggagatctggcgatgactgtggctcccgctctctgaccttctgactcctgtgggctcctgagcttacaaagcatggcaggccaagggcctcgaccacaggccagcattagcagaacatataatggtttcacccttttccagtctggagttggagcaaggagaaaattgcactaggcactccatgatctgcagagcatgttgcttttgtttttttaaaaagcaagtaaaagcgcattcctaaacagagtccggggggaaatgtactgtagggatccctcctgcacatcagtgggtgcatgtgggaactcttcttt

SEQ ID NO: 25241 - DNA, 591 bp, Homo sapiens
aagtgtagcagcagcaccagggcagggactgactccagcccttggactcaggacatcgcagaccttcccttgcgtgcgtgactcattcgcacatccatttctgtttatgcctggggtggggagaaaaatcccaaaccaggttggatggagtgcagtggcgcaatctcggctcacggcaacctccgcctcccgggttcaagcaattctcctgcctcagcctccggagtagctgggattacagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaag

SEQ ID NO: 25242 - DNA, 792 bp, Homo sapiens
gattgccgctcgctccagctgagctaagtgtagcagcagcaccagggcagggactgactccagcccttggactcaggacatcgcagaccttcccttgcgtgcgtgactcattcgcacatccatttctgtttatgcctggggtggggagaaaaatcccaaaccagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgag

SEQ ID NO: 25243 - DNA, 558 bp, Homo sapiens
gaggttgctgcttgaggttgcatgggcctatggagcagggcctggggaaagaagctgtctgcttctatactcatgtgagtctctggatcatggtggtggccttctccttcactcatgtcgggacaactgagtccatggtgcatgggaaggtagagacatagctatcaccttccccagagccagtgatactgtgcctccactgaagattgctgggaggaattgaaagtttacagttcccatctcacagtgaggatgaaatgagatcagagcacctgatacatactccattggatatgactgtgcactggagccggttgtgctgttctctcagctgtacacacccatcaaatcacagtgcccctgaggacgagagaaaattgaagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtga

SEQ ID NO: 25244 - DNA, 588 bp, Homo sapiens
agtgcccctgaggacgagagaaaattgaaggtaggcaatagcctggctgagggctcttgctcagcaatctttgtgctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaattctcagaagctcaggacatgtattatctggagacctcagccaaggaatctgataatgtggagaaactcttccttgacttagcatgcc

SEQ ID NO: 25245 - DNA, 550 bp, Homo sapiens
ttgtgctacggtctctccaccccctgctgctgctgggcttgcgattgccgctcgctccagctgagctaagtgtagcagcagcaccagggcagggactgactccagcccttggactcaggacatcgcagaccttcccttgcgtgcgtgactcattcgcacatccatttctgtttatgcctggggtggggagaaaaatcccaaaccagtttacagttcccatctcacagtgaggatgaaatgagatcagagcacctgatacatactccattggatatgactgtgcactggagccggttgtgctgttctctcagctgtacacacccatcaaatcacagtgcccctgaggacgagagaaaattgaagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagct

SEQ ID NO: 25246 - DNA, 9929 bp, Homo sapiens
tgctgggcttgcgattgccgctcgctccagctgagctaagtgtagcagcagcaccagggcagggactgactccagcccttggactcaggacatcgcagaccttcccttgcgtgcgtgactcattcgcacatccatttctgtttatgcctggggtggggagaaaaatcccaaaccagctccattggatatgactgtgcactggagccggttgtgctgttctctcagctgtacacacccatcaaatcacagtgcccctgaggacgagagaaaattgaagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgaggcacggagaagaaaaggaatcagcaactgccctgatgggccatgagatgctggggagatctggcgatgactgtggctcccgctctctgaccttctgactcctgtgggctcctgagcttacaaagcatggcaggccaagggcctcgaccacaggccagcattagcagaacatataatggtttcacccttttccagtctggagttggagcaaggagaaaattgcactaggcactccatgatctgcagagcatgttgcttttgtttttttaaaaagcaagtaaaagcgcattcctaaacagagtccggggggaaatgtactgtagggatccctcctgcacatcagtgggtgcatgtgggaactcttctttagggcttcggtggtaatcatctgggggccctggttttcttgtctaccagataaaccaaaactgggaaggccaagtacagtctctgtggtgcgtattgacgaccccatggagattttgaaaagtgttatttctcttgtccacaggcactttcaagaactttgggatgtaaaaatgaaatgaaacctttacccatgaccaacagtaacaatcattgttttaataatatatacaagctccataactccttttggtgctaatgattccgctatttcacagaccaaacgttttagtacattaatgtccttaaatgtgttatatagaaataaaaaaatgggggaagtccatgaatcagcactctttctcaaagtctcattactacctttttaaaggtggatttttgggaaaagagaatacttttccttttatgttcccctctgaatctctaccactttcttgtctctccagccctttatgtaaatgaaaacgtttgcaaaatgaaaaaaataaacaaatggttgatgacattctaatataaaaacttagctctaacacattttgagtagtatgaggaaacagaccagatatgaccaaaatactgtggattaatggactgtagtgcagggctcctagcagagcacagtccttgatagtaggtcacatcttttacttcctggtactctccatcttggacagaccaaggcttaggattttgtagattttttagtatgataagtgagaatagcaacagatgaaaagtctcacgacccatttttatatcttcgatgataaccttagaaaaattctgctcgtggaagcagattgaactgtcatttatcccctccttcttgtaataatgttaccttcagacgcttaaccatatgttctttcttttttctttctcttttcctctctatttttctggtctctccttttcttcttccctccctccctccctccttccctcccatccttatatgcctgtgttactgcaaatctccaattcaaatggaggtgtatatgcctttacttagccaatttaaaaacaggactcaaaatgggagatgtgctgctgaatatgtgtttctttttcttcagtgccatactttgatagcttccaatttgttcactgatataaatgcaaattgggaaaataattaaacctgtatgctgttgatgctgtcagatgtttctgtagcttgctgcttagcataactgagggatgagtaatggaataaggatatgatgtgtaattccactgttgctgtagatggtgacaatctcagttctgatatgttgatgtttgaaagctatttaattgtaaagaaattagtcatgtagagacatgatgtggataaagcatttctggcatttctctagcaggttctagattgaccagtgtcttgcacatgagattatgcatattttttaaggggctgatacttttggttggcctcactgtgtttttcctgatcctgtgggaaagagaaaggcatcccagaagtttgacttgtttttcttttagaatctgtctctgcaggaaagaaaagtcattttaataaaaaccaaaataatttataataattgttgcctttccctccccatcctctccactaagccagcaactaaatgtattcagaaaacaagttaatcaaggagggcagaagaattttttttaaactgtaagaaaatgttcctaagtttagatttattacctgtcatttagggcaaaaatccagtgtccccagcacatgatgacccaactttgtctcacagttgcaagtgtgttgaaaataaagttgctttgtgaacttagaggaaatggctgtgttagattggactgatttagttgcaaaataataccttttagggtcacacttgtattattccctagggtttagccttctctatatacccttggccagactcagaaggggattaaaaagctctggtcttggcctctatcttccttgttgctcctcccagcctttccataacttacccatccacagcccatcagcaggaacacatgagaatgtgggactttgtttctttttttcttagttgtatgaattccagattaggccttatggatacttgtctactaatatatctgaagtttgaaaacaatccctgacaatattgtaggtgcaataaatattagtcaaataaacatttaagtgccaaggtggggtggtagtggttgggggagctttttttgattaaacagaaattccttcaagtagaacttgagaaaggacactaaatacagtcatcttaacccaggccagaacctaaatttattggtttgcctaacagtcttattgtcatggcaatatttgctaagatgagccttctttagataaaaatgaactctcatttagtggtggatgaaaaaagagaaattgctttatcatatagtttaatttggctcggtctactaagaccaccagggttgatgtattcctccatttttggtgtgatctttttcttcattcaataaagttattaaatatatggcaaaacttttttcagtttccagtgaaaatgcatgatactcatgtcatggagtcaggcttgggaaaatctatgaaataatagtttgctgataatgatattttcttatggctttgtatagactacatcctcaaaggattttgtgcttctttgcccatagaaggctttttctccctttgtgtgcttttattaaatctgttgaattatattaatattttttgaatttacagggccaattatcttttttgatggattacttagattaggccatgggttcttcctggcctttctttttctcggtcttttaatcatttcacgtttttatctctccctgagtaaagtggcaagaaaactaaaaatgaaagttaaatgggttgatttgacaatgtgtcaagttctgatttagagtttataaggaaggtagaaacgattggccaaaataagatatttggatgaggattatttaagccgtttagatttggccagagacgccagatttagcaaaggactgggttcttatcttctttcattcatgaatatatgccttgggaggacactggtgattcccacagaattaggccaatgatttgccacattaccctttaagctagcccataattccaccagatcccacaccaagtttcagttcatgactcatactgaataaacgtcagttgtaaatgatgtttgaattggtcttcctactaaagtgaaacatcttcttttaagccaagccacatgaatgaaatagcacaatcagaaaaaaatctttttttttttttttgcatatcaaaccaatggccttctccactaagccagcaactaaaggtattcagaaaacaagttaatcaaggtgggcagaactttttgaactgtgaggaaatgttcctaagtttagatttattacctgtcatttagggcaaaaatctaatgtcttttttatttcttaatcttgtagaactctgtatttcatagtaatgagtacttagggatcattgctctattagcctctgggagagatcttctagagtttgccattcctttttttccaaaattttttgttgttgttgttgttgttttaactgcaactggttacttttctcaaccatggtcctgacatgtttatactatgatacttttgagacttcgctaaagaattaaaagctgtgaaacaacatttgcttctcatccttcagacaaaatgtgttccatttaagcagcatggttaaacactaattttgggataagggagggatatgttttctttactttctttttggatttcatttctgtggcatgagcctatttgcgtttggaaggaaagatgccttcctttacattcttcacactggtaattttttcatactgaattaagaaattatcatcccttcaaaacacatattaatatagcaacattagagtaagggagatggcatttcatctcctctcctcagtcccttgatgttggaatgttattatcatttccaggagccatactttgaaattaaaaacaaattgaggcattaccagtctgatgaaggaattttaaatgcaagccatttaaagaatacttgaaggatttggggagacttaggttaggaaaaagaggggaatacaattagtgcattagaacaagatgctctgtggttcagaggggtggaatgaggcctactgaatgaggccgtagggacacagatttgggttccatgtcagggcgaccattctcaaaaagttggttcactatgggacagtctgcctcaggtaatagcctctgtcaagaggcaaagatgtggagaggatccaattggttggagattggagcaggtgacctattaacctaaattccatgttgtatgtagtactttgcctctcataacatgttcaattaaatatctgttaattcatagctaatgatttttttaatggggcctcgttcttctgccacaagtgcatcccacctttatctttcagggaagaggttggttgcacgttgttaggccaagagactggccctccattatgccctatgctggacttgctttgtcggtccattcattgatgtcctgttgaatcaaaaggtattgttttagtagaagttacatgaagtatattcatttatcacttgctaaacataggccttgctctgtttaataaataatgggtgtctctttcaagattttaggataggcctttttaacagagcagaatcttctgttaaagttctcacaaacagaccaactcccaagagagatgggctggtgggtcactgacataaagcagtccacaagatctattttagaaaagtatcaatgacatttccttagttggtttgattctcttgagaatacatgagtttaaaagaactgaggtcaaattgctttatgtggaaagcaataaaaacaagtatttttgacttgcaaattagaggtaactgtaagcaatttttgctattgaagcctatggcccaaattattccacctgcaaaataactttcacccttgcaaggctgatagacggctcttcattggtctttttttatggttttgttttgtttttttaagtcattggtcttaaatctgtatggtgacaaatctatttgagtttgattgagactttcttggactcctttggacaagaggtcagagcacaaaggctagtcaccacttctttgacttcttgaggtatgagccaaaattttacttttccattgatttaaagcagaatttttggagatgctgtgttctagttcctgacggaatcggtggtggttgctgactttgacactttggagagtgatgtggggagttatatagaaggggaaacactagtttaggtgtgaggagttctagtatgccacaaattagctgagactttagacgaagcacaatatttgagcatcaatcttctcatctatgagatagacctgtcaggattattgtgaaaattagatgagataagttgaaagtacagtgcttggtaaacagttagcactcaaatattagttctttttcactttaattaagagcagactttgaatggtctgatgccaagtgtagatccttaagagacaaaacaaagaaactttcctggcttcaaagaaaagaactccatttctgaaagggtgccttaaaaggaattcatttgtctgatccatccttttgcctttgggcattactactgtcaccctccatttctttacaaacttcaggcaaggtggtctctctctctctcccaataggcaattccagggttgtaaactcattatcaggaagcttaatcttagaactgaaatacctcacagagcaatttaaacctctttcttcttgttcctattcttcatgggaagaaaactgggttgatccctatcttctttttaaggagccacatttgccatttattattgctcttttgcctatttaaaaaaaataacagtcagaaaaaataatgattattaaaatgatagtcattatttacttagtgaatgtcaggataggtatttattactcttagcttcttattggtatcagatgtagatcacggtcttactgttgattaactcttcagttatatatacatactttgattctttagttacataattgataacaaagtgtgcttctgaagaattattctggctgtatggctcttgtttcctccccttggtaaaaatggaggcatgaatctcggttttgtgatctgcttttaatttcatatatgacattatttgatgtacataattaccaacatccaaaagcgtttcttcccctttctacgtgtgcactaaattctaaaacaaaaattggaatacaaaatgcctaataaagaaaaaattcatgtacagaaaagcaaaagataatctactttgttaagataatttgtcactagctggttgaataatgcacagtttttgtttaaggttacacatttatgcctggattaaataacaatagtaaaacttgacaagtcttttgaaaaacagctgctaaacatattgctttctggaatgtaatcattagcaacaaatattctcttattctatacaattgcagaatgctagtggaactttcttgtaggttatttgacaatgaatgttaattgatttattttttaaaaatgtaaaatcctcttatccctttaaggccggtttaggctttcatgtccctgtgatagaaaatttcaaatgctggcttctaatttctactcactgaagtgtcttccagacataccagatggttggagctcctttgatagtatataagggagctacataaatgtatttgaactaactcgtgagcaaaatttctgttttcagcaaaaaaaaaaaaaaaaagaaaaaacaacaaactctgctcaaaatttcagataatacaggagtaaaaagaggtttttgataatctgaagggaaaagtgtgccccatatatcttgtacacacttttaatgcatgacttttagtatagagatgaaataaaatgcaaaatatataattctggagatctcagcagctagttaaaatatttagagaagctgctttatgaagacttagagaatccttgatctcccccacatttcctatcactccattgaaacatggatctttaatattaatacatacatagttttaactaataaacaggttaatcactgagttttatgaactcgattcttgatatttggctattggttttaagcataggatatcagtattatttgtatacagcgttatataaaatctaaccaacttcaatataagaatagtacttgattttaaatgttaatatgcaaatattaacagtatactacatcatattttatgtgttcatatattgatctttttacttaacaaaaagcctgttagaaatataacccactgatgacccgagtccaattagctgaaaaccttctgtagaaaggtgattgtatgaaaaattcaatcaacattaaaaaagggaagtggggagggaatacaaacttgaacaaaatattcttaaatgaagttgcatctctttttaaaattaagatatcattcatgcaccatacggtttatcctattaaggtgtaaacttcaatgtttttaatcatattcactaagttgtgcaacatcaccactccctaacttcagaacactttcatcacctccaaaagaaaccccataccatttgcaatcactcctcctcctccttcccccagcatccggcaaccactaatctactttctgtccctatgaatttgcctatcctggacatttcatatagtcaaacaacatgtggccttttgtgtctggcttctctaagtaagcataatgtttttaaagctcatccatgttgtagcataaatcagtacattgttttcatgtttaaataatattccattgcatgtatatgccacattttatttgtccatttatcatttgatggacatttgggttttttccaccttttgattataataatgctgctgtgaacatttatgtaaaagttttttgtatgggtgtatgttttcacatctctcttaaaaacaattagtctgacaaatcaaatcaaatcatttatgtttatttacgtagaacctcttgcaatcctgtttggagagtgcaacttacgatcttagtttaattgatcaattaggagacctctgaataaagactaactccccaatacatccataagaatttttctatgagcctgtcatttagatgtgataagcaatcaatttcatgaagactgtttcagtcttgtagaaattgagttgccatcacatagaggatttcttgtcctctgcattgtttaaaggacaactacaaatcatgctggataagagtactcattcaatcttttaggattcaatgaagtagcattttaaatatgtaagttattttatatattgtctgtcttttaaaattggactttgcttcttgaaaaaagtttgtcaaatcaccaaaccatatgactgtccattcattgtagcctatgttttctattattaagaaataattcatactgagagtaaaagaaaaagaatgtattttgtgtgcaaaggatgaatgtattaaaaactttttatttgtaacaattttttaaaaaaactaaatggaaattgctttcccatgtacttgtatataaataaacatttcctgttgcccaca

SEQ ID NO: 25247 - DNA, 673 bp, Homo sapiens
catcgtgtggcccagtctggttgtcaagatagatgctgtgtctagacagtcatctcccttgggaaatcacagttgcttaaaaaggaggcacgtggtctcctgttaagaatacaaaacaggcctgtgagctgttgaggaagaggttgctgcttgaggttgcatgggcctatggagcagggcctggggaaagaagctgtctgcttctatactcatgtgagtctctggatcatggtggtggccttctccttcactcatgtcgggacaactgagtccatggtgcatgggaaggtagagacatagctatcaccttccccagagccagtgatactgtgcctccactgaagattgctgggaggaattgaaagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgcctt

SEQ ID NO: 25248 - DNA, 3746 bp, Homo sapiens
gtcattgcaaaagccccactgcattcattgtgctacggtctctccaccccctgctgctgctgggcttgcgattgccgctcgctccagctgagctaagtgtagcagcagcaccagggcagggactgactccagcccttggactcaggacatcgcagaccttcccttgcgtgcgtgactcattcgcacatccatttctgtttatgcctggggtggggagaaaaatcccaaaccagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgaggcacggagaagaaaaggaatcagcaactgccctgatgggccatgagatgctggggagatctggcgatgactgtggctcccgctctctgaccttctgactcctgtgggctcctgagcttacaaagcatggcaggccaagggcctcgaccacaggccagcattagcagaacatataatggtttcacccttttccagtctggagttggagcaaggagaaaattgcactaggcactccatgatctgcagagcatgttgcttttgtttttttaaaaagcaagtaaaagcgcattcctaaacagagtccggggggaaatgtactgtagggatccctcctgcacatcagtgggtgcatgtgggaactcttctttagggcttcggtggtaatcatctgggggccctggttttcttgtctaccagataaaccaaaactgggaaggccaagtacagtctctgtggtgcgtattgacgaccccatggagattttgaaaagtgttatttctcttgtccacaggcactttcaagaactttgggatgtaaaaatgaaatgaaacctttacccatgaccaacagtaacaatcattgttttaataatatatacaagctccataactccttttggtgctaatgattccgctatttcacagaccaaacgttttagtacattaatgtccttaaatgtgttatatagaaataaaaaaatgggggaagtccatgaatcagcactctttctcaaagtctcattactacctttttaaaggtggatttttgggaaaagagaatacttttccttttatgttcccctctgaatctctaccactttcttgtctctccagccctttatgtaaatgaaaacgtttgcaaaatgaaaaaaataaacaaatggttgatgacattctaatataaaaacttagctctaacacattttgagtagtatgaggaaacagaccagatatgaccaaaatactgtggattaatggactgtagtgcagggctcctagcagagcacagtccttgatagtaggtcacatcttttacttcctggtactctccatcttggacagaccaaggcttaggattttgtagattttttagtatgataagtgagaatagcaacagatgaaaagtctcacgacccatttttatatcttcgatgataaccttagaaaaattctgctcgtggaagcagattgaactgtcatttatcccctccttcttgtaataatgttaccttcagacgcttaaccatatgttctttcttttttctttctcttttcctctctatttttctggtctctccttttcttcttccctccctccctccctccttccctcccatccttatatgcctgtgttactgcaaatctccaattcaaatggaggtgtatatgcctttacttagccaatttaaaaacaggactcaaaatgggagatgtgctgctgaatatgtgtttctttttcttcagtgccatactttgatagcttccaatttgttcactgatataaatgcaaattgggaaaataattaaacctgtatgctgttgatgctgtcagatgtttctgtagcttgctgcttagcataactgagggatgagtaatggaataaggatatgatgtgtaattccactgttgctgtagatggtgacaatctcagttctgatatgttgatgtttgaaagctatttaattgtaaagaaattagtcatgtagagacatgatgtggataaagcatttctggcatttctctagcaggttctagattgaccagtgtcttgcacatgagattatgcatattttttaaggggctgatacttttggttggcctcactgtgtttttcctgatcctgtgggaaagagaaaggcatcccagaagtttgacttgtttttcttttagaatctgtctctgcaggaaagaaaagtcattttaataaaaaccaaaataatttataataattgttgcctttccctccccatcctctccactaagccagcaactaaatgtattcagaaaacaagttaatcaaggagggcagaagaattttttttaaactgtaagaaaatgttcctaagtttagatttattacctgtcatttagggcaaaaatccagtgtccccagcacatgatgacccaactttgtctcacagttgcaagtgtgttgaaaataaagttgctttgtgaacttagaggaaatggctgtgttagattggactgatttagttgcaaaataataccttttagggtcacacttgtattattccctagggtttagccttctctatatacccttggccagactcagaaggggattaaaaagctctggtcttggcctctatcttccttgttgctcctcccagcctttccataacttacccatccacagcccatcagcaggaacacatgagaatgtgggactttgtttctttttttcttagttgtatgaattccagattaggccttatggatacttgtctactaatatatctgaagtttgaaaacaatccctgacaatattgtaggtgcaataaatattagtcaaataaacatttaagtgccaaggtggggtggtagtggttgggggagctttttttgattaaacagaaattccttcaagtagaacttgagaaaggacactaaatacagtcatcttaacccaggccagaacctaaatttattggtttgcctaacagtcttattgtcatggcaatatttgctaagatgagccttctttagataaaaatgaactctcatttagtggtggatgaaaaaagagaaattgctttatcatatagtttaatttggctcggtctactaagaccaccagggttgatgtattcctccatttttggtgtgatctttttcttcattcaataaagttattaaatatatggcaaaa

SEQ ID NO: 25249 - DNA, 580 bp, Homo sapiens
tttctgtctagctggcagggtcaccggaggggagctttaaattgctctttaaatgagtcagacctgttcccccggagagaaggctggtgcagcttgagctctgtgggcaagtctgactgggcctttctcacttttgcctgtgtttgccttgcagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaat

SEQ ID NO: 25250 - DNA, 3994 bp, Homo sapiens
ggccggcggccacgtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattagggggtgattcttaaaggacattaggattggtgctcagaaatggttaatcatgctgtgtgctagccagggccagctggtaccttctttgccatgagcattcaagggacggctaacctttattgacaatctatatcgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgagttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgtggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagttttaccgtt

SEQ ID NO: 25251 - DNA, 825 bp, Homo sapiens
tgtcttttgaatgacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgct

SEQ ID NO: 25252 - DNA, 1217 bp, Homo sapiens
ggccgcgagcactggcgggttctgggtcctgtgaccggtcaggcggcgtcagcgggcgcggcggagggctggccggcctcgggggagtttccgcggccgccgggggcgcggcggcagagcgcgaggccgggcagggggccagactcggagtcgaggcgcgcccgacagccgcagcgctcatggcgggcggaggagccggggaccccggcctgggggcggccgccgccccagcgcccgagacccgcgagcacctcttcaaggtgctggtgatcggcgagcttggcgtgggcaagaccagcatcatcaagcgctacgtccaccagctcttctcccagcactaccgggccaccatcggggtggacttcgccctcaaggtcctcaactgggacagcaggactctggtgcgcctgcagctgtgggacatcgcggggcaggagcgatttggcaacatgacccgagtatactacaaggaagctgttggtgcttttgtagtctttgatatatcaagaagttccacatttgaggcagtcttaaaatggaaaagtgatctggatagtaaagttcatcttccaaatggcagccctatccctgctgtcctcttggctaacaaatgtgaccagaacaaggacagtagccagagtccttcccaggtggaccaattctgcaaagaacatggctttgccggatggtttgaaacctctgcaaaggataacataaacatagaggaagctgcccggttcctagtggagaagattcttgtaaaccaccaaagctttcctaatgaagaaaacgatgtggacaaaattaagctagatcaagagaccttgagagcagagaacaaatcccagtgttgctgatatatggcttctgcttctcttgtgtgtgcctcagctctgaagaagttcctgagaatgggttacagatgtcatgttagctgggagtcttcccacatgtggcacttcaaaaggcagcaccactgggcgcctgcacttatttgaaaatggaactttgggagaagtatccctgctagtggctctgtaacttaacagatgacaattaggcttttgtcattgttgccatcatatggaagataatgtttacatccttttaaacatttttatatgacaattcctcaggatttggtaaggcttccaagttgtagcttttagtgtaagtgctggggtggtaataaaatgttacctccagtcttatggtca

SEQ ID NO: 25253 - DNA, 1258 bp, Homo sapiens
cgggtccgtcccgggaatgcaggcaggggagggtgtgggccgaggcgcggcggcggctggagcagcgcggtagggtccttcgccagagcatccggtccgagggcgcacacaggcagaaggctcgcggctcgtccactctcctccctctctcctcctctccctggcttttgtgttggtgcctccgagctgcaaggagggtgcgctggaggaggaggaggggggcccggagtgagaggcacccccttcacgcgcgcgcgcgcacacggtgccggcgcacgcacacacgggcggacacacacacacgcgcgcacacacacacgcacagagctcgctcgcctcgagcgcacgaacgtggacgttctctttgtgtggagccctcaaggggggttggggccccggttcggtccgggggagatggcgcagcccatcctgggccatgggagcctgcagcccgcctcggccgctggcctggcgtccctggagctcgactcgtcgctggaccagtacgtgcagattcgcatcttcaaaataatcgtgattggggactccaacgtgggcaagacctgcctgaccttccgcttctgcgggggtaccttcccagacaagactgaagccaccatcggcgtggacttcagggagaagaccgtggaaatcgagggcgagaagatcaaggttcaggtgtgggacacagcaggtcaggaacgtttccgcaaaagcatggtcgagcattactaccgcaacgtacatgccgtggtcttcgtctatgacgtcaccaagatgacatctttcaccaacctcaaaatgtggatccaagaatgcaatgggcatgctgtgcccccactagtccccaaagtgcttgtgggcaacaagtgtgacttgagggaacagatccaggtgccctccaacttagccctgaaatttgctgatgcccacaacatgctcttgtttgagacatcggccaaggaccccaaagagagccagaacgtggagtcgattttcatgtgcttggcttgccgattgaaggcccagaaatccctgctgtatcgtgatgctgagaggcagcaggggaaggtgcagaaactggagttcccacaggaagctaacagtaaaacttcctgtccttgttgaaaccaaacgatataaatacaagataaattatcactggagttttttctttcccttttttctgtgcctgcataatgctgacacctgcttgtttccatacaaattgatatcaaaataaaatttgtatagatta

SEQ ID NO: 25254 - DNA, 1293 bp, Homo sapiens
ggttcctggcatcgccagatgctgcgcagcagtctccgattccccatcaccaattcggctggcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtggggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagc

SEQ ID NO: 25255 - DNA, 1592 bp, Homo sapiens
cagccttgaaggaaaagacgccagacttcagacgtctctctcctcggtgggcacctcattctaaccctggcacccccttcgcacgcttcccctccaccatcctcacccccgacctcccagggcagaagggcgagagggggcagactctatgagtcacctcccaggcctggagttgaggagggaagcgccgcctctccttgggccccttctctccccctttcccctccctgctggttcctggcatcgccagatgctgcgcagcagtctccgattccccatcaccaattcggctggcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 25256 - DNA, 1060 bp, Homo sapiens
ctccttgggccccttctctccccctttcccctccctgctggttcctggcatcgccagatgctgcgcagcagtctccgattccccatcaccaattcggctggggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccg

SEQ ID NO: 25257 - DNA, 1597 bp, Homo sapiens
cgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 25258 - DNA, 1736 bp, Homo sapiens
tccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgcc

SEQ ID NO: 25259 - DNA, 717 bp, Homo sapiens
cacaatctacacagcagccttgaaggaaaagacgccagacttcagacgtctctctcctcgggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccg

SEQ ID NO: 25260 - DNA, 983 bp, Homo sapiens
gcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggcagatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 25261 - DNA, 1314 bp, Homo sapiens
tatgagtcacctcccaggcctggagttgaggagggaagcgccgcctctccttgggccccttctctccccctttcccctccctgctggttcctggcatcgccagatgctgcgcagcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagcactt

SEQ ID NO: 25262 - DNA, 1183 bp, Homo sapiens
atgctgcgcagcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagc

SEQ ID NO: 25263 - DNA, 1099 bp, Homo sapiens
tatgagtcacctcccaggcctggagttgaggagggaagcgccgcctctccttgggccccttctctccccctttcccctccctgctggttcctggcatcgccagatgctgcgcagcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggcagatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagcactt

SEQ ID NO: 25264 - DNA, 3828 bp, Homo sapiens
ctgccagccccgcccagactccaggcaggttctcgttgctatggtgatcgccggtgcaagctggatgcttggacgcgccgctgccagtccaacgcagaccccgcccacgacgtcgacgattcgtgtagcccgcaggtcccgcgtggctctcgttgccatggtgatcgccgccgctggctcaggcggaccaggccgcgcggagccccagctttcacagccatcgctggactgtggaagaatgaggtcctccctgacacctttggggccccctgtgagccgcgaccgtgtcatcgccagcttccctaagtggtacacgccggaagcctgtttgcagctcagggagcacttccacgggcaggtcagcgctgcctgccaacgcaggaacacggggactgtcgggctcaaactctccaaggtggtggtggttggcgatctctacgtggggaagaccagcctcatccacaggttttgcaagaatgtttttgatcgagactacaaggccaccattggggtggactttgaaattgagcgctttgagattgctgggattccctatagcctccagatctgggacacagctgggcaggagaagttcaagtgcatcgcatctgcctactaccggggtgcccaggtgatcatcacggcctttgacctcactgacgtgcagaccctggagcataccaggcagtggttggaggatgctctgagggagaacgaggcaggctcctgcttcatcttcctcgtgggaaccaagaaggaccttctgtcaggggccgcatgtgagcaggccgaagcagacgctgtgcacctggccagggagatgcaggccgagtactggtcagtgtcggccaagactggcgagaacgtgaaggcattcttcagccgcgtagccgccctggcattcgagcagtcggtgctgcaggacctggagaggcagagcagtgcccggctccaggtcggcaatggagacctaatccaaatggaagggagtccgcccgagacccaggagagcaagaggccctccagcctgggctgctgctaactggggcctgcgtggaaggcctccgctccctgcacacacacggacaggaatttccgtgactgtggtgtggagactggagcccaagctctgcagcgtgtcgccctcaagctgtaggcccatgttccagtccctccacccacccaccgggctcagctccagggcacagtcacttgtccgttgcaggttgggcactagaaaaggcccccactggctgcctgggagccccacaccaccgggccagtgcaggcactgtggtgatcccataaaaggccagtccatttgcagggtcatcagacagtcacctttggcctcaagaggcctcagaactgcaaactcctgcgtcggtctatactactcggccatggcccacatcagcagtcaaccctgcactctttcccagcgatcttggatgtgtccccaggatccgtcacagtgttccaggcaacctggacttgtcaaagtcagcacctgaaggagaggccacctgccattccccctgggagttttctgttgtcagcaggacttatggttctgggtctcagagcttcaggcctcactgtccttctgccacggatgctcaaggttcctgggcagaccagcacctctggaggacaatggacaaaatgtctcttagacctgttctggctgaagggctatctctggcacctctgagatccctaggtcctgccctcctggtccgtgggccaggatgtgcagaacaaccactcaggcctttctggcccacctggacagtgcatttacctgtgtgctgcgggaggcagactgcacagctgtcctagggtaactcactctgcagcccttgaacatggcactgccctcctctggcactcatgctgggcctgtgcccactgctgcctctccatccctctctcattggcctatacatctcttaggacctttgtaatggtgtccatgcacctttagaggacttcagaggccctgccaagtctagcatgttcctgtctccaacaccgcctcctgcacatgcagagcagacagaaataccccacacattccccagcctctctgcccagtatgctcatccacagggttttctcactgctatgaaccagccccacagccccaggcccctgtcacctggctatgcccactcatcccacccgtctcgtgctgttgcttcccgtagatggcgagcaccttgcaggcagccttctgatcagtactgctctcctagggcctggcacactgcagctgccctgtaaatgttcagctcagcgattgccaaataccagttagggaagaacactggcatctttttctattcattcccccttcaacatattttttgtagttttttatataaatgacttttttttttttttgagatggagtttcacccttgttgcccaggctggagtgcaatggcgtaatctcggctcagtgcaacctctgcctcccaggttgaagcgattctcctgcctcagcctcccaagtagctgggattacaggcatgcaccaccatgcctggctaattttgtatttttagtagagatggggtttctccatgttggtcaggctgctctcggactcctgatctcaggtgacctgcccacctcggcctcccgaagtgctgggattacaagggtgagccaccatgcccggccataaatgattttattcatttttatgttttcttttgggcggcgggatggagtctctgtcacccaggctggcgtgcaatggcacgatcttggctcactgcaagcttccccttccgggttcatgccattctcctgcctcagcctcccgagtagctgggactacaggcacgtgtgaccatgccgggctaattttttatatttttagtagagagaggtttcaccgtgttagccaggatggtctcgatgatctgacctcgtgatctgcccgcctcggcctcccaaagtgctgggattacaggcctgagccaccgcgtccggcctccataaatgacttttaaaggggttgtatgtttagtgtgaacaaagacagtacaaagcatataaaatacaaggtgaaagccccccccccgccacattagctgcgcccctgaagtgtctccagcagaagagatggatgaatggaaggacacacagatggacagagagcaggaaagactgttagctctgctaacagtcaggactattccttctggactctgtgcctttgcctgcacagctagtgttgatggcttgtttgttgttttcaccagagtgagctccttctggacatactgcctggcagcctgccttcctagggagctggcgccaaggcctctccctgatggcacacaaggagcctccttcctgtagcagcgcccagttttcatgtggatggattgtagttcatttgaccctccccatccgcgggccatccggcttgtgtccagcttttagctcttgccaatggtgctgcagtggccattcttgtagttatagctttgcgtactcaggaaggcccttctcccgactgcggcccccagcctggtccactaaatgcagcctgtggtcgggcagacagcattggggtccattaggaagaccaggtttgctgggcataagcttcacaggacgggagaacctgcccatggtggactgtcgttctccacagctcccttcccttgccccttcgggcctccaggatatgtttgcgggggtgggtgtggtgtccagctgttaccagcttctgagctagagctgtactgcctcacgtacacccccacctctgtaaatggtccttgattaaatcgtcctcatattacctcc

SEQ ID NO: 25265 - DNA, 936 bp, Homo sapiens
atggtgatcgccggtgcaagctggatgcttggacgcgccgctgccagtccaacgcagaccccgcccacgacgtcgacgattcgtgtagcccgcaggtcccgcgtggctctcgttgccatggtgatcgccgccgctggctcaggcggaccaggccgcgcggagccccagctttcacagccatcgctggactgtggaagaatgaggtcctccctgacacctttggggccccctgtgagccgcgaccgtgtcatcgccagcttccctaagtggtacacgccggaagcctgtttgcagctcagggagcacttccacgggcaggtcagcgctgcctgccaacgcaggaacacggggactgtcgggttttgcaagaatgtttttgatcgagactacaaggccaccattggggtggactttgaaattgagcgctttgagattgctgggattccctatagcctccagatctgggacacagctgggcaggagaagttcaagtgcatcgcatctgcctactaccggggtgcccaggtgatcatcacggcctttgacctcactgacgtgcagaccctggagcataccaggcagtggttggaggatgctctgagggagaacgaggcaggctcctgcttcatcttcctcgtgggaaccaagaaggaccttctgtcaggggccgcatgtgagcaggccgaagcagacgctgtgcacctggccagggagatgcaggccgagtactggtcagtgtcggccaagactggcgagaacgtgaaggcattcttcagccgcgtagccgccctggcattcgagcagtcggtgctgcaggacctggagaggcagagcagtgcccggctccaggtcggcaatggagacctaatccaaatggaagggagtccgcccgagacccaggagagcaagaggccctccagcctgggctgctgctaa

SEQ ID NO: 25266 - DNA, 1317 bp, Homo sapiens
gttgccatggtgatcgccgccgctggctcaggcggaccaggccgcgcggagccccagctttcacagccatcgctggactgtggaagaatgaggtcctccctgacacctttggggccccctgtgagccgcgaccgtgtcatcgccagcttccctaagtggtacacgccggaagcctgtttgcagctcagggagcacttccacgggcaggtcagcgctgcctgccaacgcaggaacacggggactgtcgggctcaaactctccaaggtggtggtggttggcgatctctacgtggggaagaccagcctctctgcccagtatgctcatccacagggttttctcactgctatgaaccagccccacagccccaggcccctgtcacctggctatgcccactcatcccacccgtctcgtgctgttgcttcccgtagatggcgagcaccttgcaggcagccttctgatcagtactgctctcctagggcctggcacactgcagctgccctgtaaatgttcagctcagcgattgccaaataccagttagggaagaacactggcatctttttctattcattcccccttcaacatattttttgtagttttttatataaatgacttttttttttttttgagatggagtttcacccttgttgcccaggctggagtgcaatggcgtaatctcggctcagtgcaacctctgcctcccaggttgaagcgattctcctgcctcagcctcccaagtagctgggattacaggcatgcaccaccatgcctggctaattttgtatttttagtagagatggggtttctccatgttggtcaggctgctctcggactcctgatctcaggtgacctgcccacctcggcctcccgaagtgctgggattacaagggtgagccaccatgcccggccataaatgattttattcatttttatgttttcttttgggcggcgggatggagtctctgtcacccaggctggcgtgcaatggcacgatcttggctcactgcaagcttccccttccgggttcatgccattctcctgcctccataaatgacttttaaaggggttgtatgtttagtgtgaacaaagacagtacaaagcatataaaatacaaggtgaaagccccccccccgccacattagctgcgcccctgaagtgtctccagcagaagagatggatgaatggaaggacacacagatggacagagagcaggaaagactgttagctctgctaacagtcaggactattccttctggactctgtgcctttgcctgcacagctagtgttgatggcttgtttgttgttttcaccagagtgagc

SEQ ID NO: 25267 - DNA, 3805 bp, Homo sapiens
ttcatcccctgccaggagagcatagtagctcacatttattgagttcttagtacacgctgggcactgttctaggctttttacatgaattaactcattaaatactcagaacaaaaccatgaggcaggtactattataatattatctccattttgtggacacttaggaaagattaatttgcccgagtttgcacgactaataattttcagaatcgagatttgaatcctggagcctgtgctcctaaccaaaccaccatctgcctctcctgagcccattgtccttaacttcttgcggtcatgtgtgctggagagaatgtgatcaaagccctggaccttctccctaggaaaacgcaggtaaacagaattttgcatatttcagggactttggggacacctaagacccatctactgtcgacctcagacttagaagctctatttatctcatacatcctggagagaattgtccagggacaaaaacagaagcgccgccagcgccgcaggacttcgcctctgcaaacgtgtgaggagagctgcgctgcgctgagctgcgtggtgacggagatgcccgttcgctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactgtccagtgctgaaaacggatgcggcccggcccgcagagctcagacccaagcctgccgcacccagcggagctcgaaccgagctcctggaagcgctgacgcagagcgcagggagagccggagcggcgagctccaagcctggcatggacctgcagagacccgattcctaccagggaggagctggccctgacttcaacgaccacgtcctgcataagaccatcctggtgggtgacagtggtgtgggaaagacgtctctgctggttcagttcgatcagggcaagttcatccccggctccttctcggccactgtgggcatcggattcacgaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 25268 - DNA, 2858 bp, Homo sapiens
ttcgcctgcgggccggcactgctcacctctcgtccagggacatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 25269 - DNA, 2528 bp, Homo sapiens
ccttcgcctgcgggccggcactgctcacctctcgtccagggacatgacgggcacgccaggcgccgttgccacccgggatggcgaggcccccgagcgctccccgccctgcagtccgagctacgacctcacgggcaagaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 25270 - DNA, 2617 bp, Homo sapiens
gttcctgcgctctccttcgcctgcgggccggcactgctcacctctcgtccagggacatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgag

SEQ ID NO: 25271 - DNA, 2704 bp, Homo sapiens
gactacgggaactcttccgcagcagacggggtccccgcggcccgctcccccaggggcaagcaagcgaccacaggggaccggtcccggggctggatgtggctcatgtccgaagcgcacggagccgagccggtgttgctcagggaggctgcccgccccttcacgcagaccctgcggctctgcgtgccctcagggaacagcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 25272 - DNA, 2690 bp, Homo sapiens
ggaggcgcagcccaggggtccccagctccccgcctcgccacctggggacagcccacggcccggggctcgggcgccgcctgctgtcgcggtgcgcagcgactacgggaactcttccgcagcagacggggtccccgcggcccgctcccccaggggcaagcaagcgaccacaggggaccggtcccggggctggatgtggctcatgtccgaagcgcacggagccgagccggtgttgctcagggaggctgcccgccccttcacgcagaccctgcggctctgcgtgccctcagggaacagcaagaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 25273 - DNA, 3780 bp, Homo sapiens
aatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactgtccagtgctgaaaacggatgcggcccggcccgcagagctcagacccaagcctgccgcacccagcggagctcgaaccgagctcctggaagcgctgacgcagagcgcagggagagccggagcggcgagctccaagcctggcatggacctgcagagacccgattcctaccagggaggagctggccctgacttcaacgaccacgtcctgcataagaccatcctggtgggtgacagtggtgtgggaaagacgtctctgctggttcagttcgatcagggcaagttcatccccggctccttctcggccactgtgggcatcggattcacgaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggtgagtggctccggggcagggtcagcccagccctgcacttcctcagccctagccggccccataaccacccaagaacagttatctaggcatccttcctgaaaaggactctgcagcctccagctcaggggtcagacatatctggaggcttctgcccatcccatctgccccttccagggaaagtccaagttgttgcctgagaaatcaaggggtgcccagttctcagcccccattagagcagagtgaacagggtcccaggtcaggggctaagagtgcaaagggttagccccaactgctgtcctattccaagaccctttaccaaaggtgagatcccagagctgggagctacactgggcagaaaccctggccccaggccaatcacacctgcctgcagtcccttgggccaccagcagagggcaggcaacgcctgcttctggggcaaaatatgggcccgctggggcggaggcctccttccccagagtgacccatttgggcttgacaggcggatatgagcagcgaaagagtgatccgttccgaagacggagagaccttggccagggtaagtgattgtctgtgggacagggtgaagggtgggggcaacccgacgctggccctgaggacactctctcccgggcaggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 25274 - DNA, 3044 bp, Homo sapiens
agctgcgtggtgacggagatgcccgttcgctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactgtccagtgctgaaaacggatgcggcccggcccgcagagctcagacccaagcctgccgcacccagcggagctcgaaccgagctcctggaagcgctgacgcagagcgcagggagagccggagcggcgagctccaagcctggcatggacctgcagagacccgattcctaccagggaggagctggccctgacttcaacgaccacgtcctgcataagaccatcctggtgggtgacagtggtgtgggaaagacgtctctgctggttcagttcgatcagggcaagttcatccccggctccttctcggccactgtgggcatcggattcacgaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagc

SEQ ID NO: 25275 - DNA, 1730 bp, Homo sapiens
ggagatgcccgttcgctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactgtccagtgctgaaaacggatgcggcccggcccgcagagctcagacccaagcctgccgcacccagcggagctcgaaccgagctcctggaagcgctgacgcagagcgcagggagagccggagcggcgagctccaagcctggcatggacctgcagagacccgattcctaccagggaggagctggccctgacttcaacgaccacgtcctgcataagaccatcctggtgggtgacagtggtgtgggaaagacgtctctgctggttcagttcgatcagggcaagttcatccccggctccttctcggccactgtgggcatcggattcacgaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttcccccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 25276 - DNA, 1654 bp, Homo sapiens
acatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 25277 - DNA, 1494 bp, Homo sapiens
aaagctctcccctggtgggacattctgggcacaaccaacaggccgggggaaatgagaggtgatccatactaaagggtcaaagtccccgcaccaggcagaggccccaaaacaccgcagcgtacatgtgctgcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacct

SEQ ID NO: 25278 - DNA, 1444 bp, Homo sapiens
ttgcgctccccaagtctctctcgtgcgcagagcccaggctgcgcttccctggtcaggcacggcacgtctggccggccgccaggatgcaggccccgcacaaggagcacctgtacaagttgctggtgattggcgacctgggcgtggggaagaccagtatcatcaagcgctacgtgcaccagaacttctcttcgcactaccgggccacaatcggcgtggacttcgcgctcaaggtgctccactgggacccggagactgtggtgcgcctgcagctctgggatatcgcaggtcaagaaagatttggaaacatgacgagggtctattaccgagaagctatgggtgcatttattgtcttcgatgtcaccaggccagccacatttgaagcagtggcaaagtggaaaaatgatttggactccaagttaagtctccctaatggcaaaccggtttcagtggttttgttggccaacaaatgtgaccaggggaaggatgtgctcatgaacaatggcctcaagatggaccagttctgcaaggagcacggtttcgtaggatggtttgaaacatcagcaaaggaaaatataaacattgatgaagcctccagatgcctggtgaaacacatacttgcaaatgagtgtgacctaatggagtctattgagccggacgtcgtgaagccccatctcacatcaaccaaggttgccagctgctctggctgtgccaaatcctagtaggcacctttgctggtgtctggtaggaatgacctcattgttccacaaattgtgcctctatttttaccattttgggtaaacgtcaggatagagataccacatgtggcaagccaaagatctatgcctctgttttttcagtgagagagaaatagcaaatgttctttctatgctttcctcaccatcatcacagtgtttacaaacttttgaaaatatttagtctgttacaaacttctgtcatgtagctgaccaaaatcctgcagggccacagtcggcactgttatttgcttcttttaatcagcaaaggcctcaagtcttaaaataaaaggggagaagaacaaactagctgtcaagtcaaggactggctttcaccttgccctggtgtctttttccagatttcagtatattctctgatggcctgacaggcctattaagtagatgtgatattttctcccaagatgacctccattctcggcagacctaagagttgcctctgagttagctctttggaatcgtgaacacaggtgtgctatattgtccttgtcctaactgtcacttgccatggcctgaatgttggcttaactgaatattgtatgaaaagacatgcctccatatgtgcctttctgttagctttctctgactcaagctgtggggctcctctatacatgctatacatgtaatatatattatatatatttttgcaagtgaacaataaaacattaaaagat

SEQ ID NO: 25279 - DNA, 3505 bp, Homo sapiens
ctcttacagatagtgcggcggcccaggcgtcgcgtctacgcgggggattacagtaacccggttgtcagtgatgagtcagagtgcgtggtgctgatgctgctgccatttcatcacctttgcgagcgcagcatccatccctccgctctcccggcgcctgggcctacccagcttcgggctcccaggccagcgatgcgctcgcggctgagctagatcctgccgagccgcgctctctgaggcgtcggcggggcgccccctcccgccgtccccggtccgggccaaggagacctgcagagccgcggccatggaggccatctggctgtaccagttccggctcattgtcatcggggattccacagtgggcaagtcctgcctgatccgccgcttcaccgagggtcgctttgcccaggtttctgaccccaccgtgggggtggattttttctcccgcttggtggagatcgagccaggaaaacgcatcaagctccagatctgggataccgcgggtcaagagaggttcagatccatcactcgcgcctactacaggaactcagtaggtggtcttctcttatttgacattaccaaccgcaggtccttccagaatgtccatgagtggttagaagagaccaaagtacacgttcagccctaccaaattgtatttgttctggtgggtcacaagtgtgacctggatacacagaggcaagtgactcgccacgaggccgagaaactggctgctgcatacggcatgaagtacattgaaacgtcagcccgagatgccattaatgtggagaaagccttcacagacctgacaagagacatatatgagctggttaaaaggggggagattacaatccaggagggctgggaaggggtgaagagtggatttgtaccaaatgtggttcactcttcagaagaggttgtcaaatcagagaggagatgtttgtgctagtcagttcttttatttccaaaacatgctctcctacttgaactgaaaagtaagagaaataaatagaatctttgtgtaactgatgagaactcaacctccatttggataccaagtgagcctccctctcagggggactctgacagactcgtgtgcgggtggatgggggtgcctgagtgctgtgaccaagggactgaattgctgacatgggccaggccaggcactgttttgtggcccatgctaggcagtggctgctccatgagccctttgtggaccacatgttaaaggcctggggtttaggaagctaagtcccaggaaaacatacctacagacaggacaactgttccttggtatttgagctcacttataggccatgaacataaagaaatacataaaggggaaaaaagtttcacaatggggacaattagcataactaaacaaagattatgagctctacttattccgtgagaataccctgcaccaaaggtgtttgctgggtttggttaaaaggtaccaattagcttttaacagctttctgtaaaatgaggaacacagaccaaaaggtctggtgttcaagtaaaaatgatgtgactatggaaaggaaggcaatcgacacagttattagcacatttcagaaaatgaacacccttgtgatagaattaccagctgtatgaaacaaattgtcccatgcaaattaccctataactaggaaagagacactataacccaaatgccataccccctttttcctttgaccatgcctggggtttcaatgccttggcacctgcaatctggaagtaaacagtctgcttgcttcttcaggcacgtgacagtgacaacacagtgactgcctctgaaaagagccctgaggcaaacactctctcctgctgaacaggaggcactgtaacccttacaaacagcttacagttacttgggctacttatttgatcatcataacaggcctacgaggtttttgccccattttacagaatagtaaactaagagccatgaaaatcacttggccagggtcaaggactcgtgactcctagctcttttcactgcatcatactgctgtcagatgaataaatgattatgaatttgtttacttgggaagagatatgactataaataaatgttctctacatgttaggatatgttttccttattgattacaactcagctataatcctgagggaacatgggaaggaatcaaaggtaaagcccattcaggcattattgacaagagggctttaaacaagtgaataattgcacaactaaaaagacattagaactgtgtgggctataagtgttcttatcactgagacacagtggatttttattgaaaggaaccacgtacagcaatgcggagtgggatagggataaaatacccaccccaaaatgaccttggccacctgtctgccatatacgtacactgagttcctgtctacccaagagagtcagcccttaattctcaggtgaacaaacagctaactgcatcagcaaattggaatggctggcttgaagtttccattattttcttgaagagaggtgatgctttaaattactttttggattgtagccagttcagctaggcaaaagccatacttttcacaattaaaaaaaaaaactattctgactagagtcaggtttctcatatccatcgtgataggaaggcctaagaatggcaaatcgctttgagatataatattgaacttcagtatgaatgtgaccgaatctgaaactttgggaatttgctttagccagaataaagaaaccaaatcatgaaaattatggaagactattctgccacctgtgccccaagttggatgagcaaaccactttggatcagttcacagcattaactacaagtgaactgatcatcttctctatattcatttcacaagagctggcttaggtggggtaattaaattgccaccttcgtggttgtaaaagacaaacaaaacatggcaaatttcattaacacaaaatttcatcaactgctatactgaattatgtttagaagattctgaaagcaagattatccagtgggtaaatgagagtcgactggattctgtcagttcaaaaaaggaaagaaacaaaacttccctacaattttcttcactaaaatttattatatgtacagtattcccactcctggcattttctggcaggtttaaaaatattcagcataaatccagcagaggtggctgagcttaattgcttaaataagttctagaaaatttaaaaatcattttagtagaattcagtaccattgtcactgcaataagtgggttttagaaaataagtgtgaaaagaatcaggtgttaatataatactaaggataaagctttagaagctattttactacataggtaaagaaaagataaactaacttgtaacaaagaccacaactgcatgttggattagattgtctcatatttcagaataaaatgtactgtatacttttcctcactttgttgtgcactgtaatgaaatgtgaaaaatgctttatttagctgtatgtgaatgaaaatatgcttgtatttagtaaaatgattgattatgtga

SEQ ID NO: 25280 - DNA, 1483 bp, Homo sapiens
gaggactgcaggggcctgagccgctgctgccgccgccgccgcgcagccccacatcaacgcaccggggtcctgtcaccgccaccgccaaaaaagtcaccgccgctagggtcgccgttgcatcggtgcagggcaagatggcatccgccacagactcgcgctatgggcagaaggagtcctcggatcagaacttcgactacatgttcaagattctcatcatcggcaacagcagcgtgggcaagacgtccttcctcttccgctatgctgacgactcgttcacgcctgccttcgtcagcaccgtgggcatcgacttcaaggtcaagaccatctatcgcaacgacaagaggatcaagctgcagatctgggacacagcagggcaagagcggtaccggaccatcaccaccgcatactaccggggcgctatgggcttcatcctcatgtatgacatcaccaacgaggaatccttcaatgcagtgcaggactggtccacccagatcaagacctactcatgggacaatgcccaggtgctgctggtaggaaacaagtgtgacatggaggatgagcgggtggtgtcatcagaacgtggccggcagctagctgaccaccttgggttcgagttctttgaggcaagcgccaaggacaacattaacgtcaagcagacctttgagcgcctggtggatgtcatctgcgagaagatgtccgagtcgttggacacggcggaccctgcggtcacaggcgccaagcagggcccacagctcagtgaccagcaggtgccaccgcaccaggactgcgcctgctgagagccatcccactccctttcccctcttccctgtcttccccaccttcccccaactacccgggcctgacccggcccctaccagccacgggcacaagacccctgctcctgacttagcccgtcacccttatttattattgtagctatttatttatttattgaagatgtcccccaggggcccaggctcccctgcccgccccaagccctgcccctcctgtacatatagccctttccccactcagctgtggtgtctcgtggccccgtgaactcaccgctcaccctcctgaaccccccccccccgcctttttttaaaattcacccccatccacagttgtcagttgtgaagaggggccagatgacaccctaaagcaggctgatcgggcaatgggaggtggccaggcctgccagcccctcggctctgccgcggtgggccgaggccgctgttgggggtttccctgtgtggaccatggggatcagagtctggcctgccaggctcctctccccgttttctcttttggtgggggggtgtgctgtgggtattcaccaccctgggaccccccccccccccgcccaccagacctgttctgacctcatgagtgtcaaacgtgccccccagttccttaggagatgtcatgacaacactacacgcacccaataaagcgaatggaccatccatgtgtgtccctgtga

SEQ ID NO: 25281 - DNA, 12844 bp, Homo sapiens
agactccgcccttgggcggggcctggatgcggccggagcggagcagtgctggagcgggagcctcagccctcaggcgccactgtgaggacctgaccggaccagaccatcccgcagcgccccgccccggccccctccgcgccctcccgacgccaggtcctgccgtcccgccgaccgtccgggagcgaacccgtcgtcccgcactcggagtccgcgatggcttcagtgacagatggtaaaactggagtcaaagatgcctctgaccagaattttgactacatgtttaaactgcttatcattggcaacagcagtgttggcaagacctccttcctcttccgctatgctgatgacacgttcaccccagccttcgttagcaccgtgggcatcgacttcaaggtgaagacagtctaccgtcacgagaagcgggtgaaactgcagatctgggacacagctgggcaggagcggtaccggaccatcacaacagcctattaccgtggggccatgggcttcattctgatgtatgacatcaccaatgaagagtccttcaatgctgtccaagactgggctactcagatcaagacctactcctgggacaatgcacaagttattctggtggggaacaagtgtgacatggaggaagagagggttgttcccactgagaagggccagctccttgcagagcagcttgggtttgatttctttgaagccagtgcaaaggagaacatcagtgtaaggcaggcctttgagcgcctggtggatgccatttgtgacaagatgtctgattcgctggacacagacccgtcgatgctgggctcctccaagaacacgcgtctctcggacaccccaccgctgctgcagcagaactgctcatgctaggcaaggcccaccttcctgacctcccctcattgtggccccacacccagtctgcttctccctgttacacactgtccgctctcagcccactctccctgttacacactgcccacactcagagcaagatgagttgctgctattctttgcctgcccctggggttctctgcagatggtcccagtaatagatactcagcactagactaacataacaggtcactacacgggtgcagaatcactttacaaaagaagactctgttttacgaaggggattcactacagggacttagagaacagtctcttttctgcctttaaaatgagagttcctccatttaccaaaatttgacacgcacacattcttcaggggcatgccaattgcgtaaagtgaggctcgcctgcatagctaatcctgttaaagacaacttctcaaagcacaacgtgcttgtttcctatcgggctccctgcggggctttctctcactacaagtcaagcttgggctctcaaagccctgcgcctgttaccacggatgcccacagggcctgggcagttgctgtggcgacaggaagagctaatcttcagagagctcagactctctaatgatgctgaaggagcaaaggctgagtcagaaacacacttaagagaaaaggattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagagaaaaggattatcccctacaaaatgtcagaggttcctgctatatgaaagagcaagtaggtatgctcaagaaagacaaacagagaaaaagagaaacaggcaagatcaagaaacagatcatgagtttctgattttgctgctttccagttggttcttaactgtgggaacttagtgaaattggttattagttcttagactcctagaacctgaggattttagatttgacgggatgcccaaatttacctagtctgactagtcagttctaaccttcctttttctgacaagtgactgtcaagcctaacaatcaaatctctttcttttaaagcacaccttctaggcagggacaggagctcattttccacaccatctttgtcaactctcatagaaagttttccttgtatcgagctcaaatctgcctcctggaaattcttcttcttcttccctccctgttggtaccagctctgctgtcagagacttcacagtctgtgctccctctgccctgtgacgtcttcagactatttgagaacaggaatcatgactcctgggacttgccttttctctaggtcaaatacctctataattccatctgctgttcttcatagggtcttctccctatcctgcccttttcctccaatccatcttttaactgctcttgagcagtctaactgagaagtatgattcaaagcaaaataaatcttaaggtggcatgactctgaaaaaattgagaaaattgaactcagagatcccgatcccaacccctttctcctgggagtgaaaccttagtttctaccagagagtgtgggaaaccacttctggtggaagccccttaattaaatacctgaggaaaaaaataaaagaaactcagagaccagaataaattagctcattattctagcttgcttggccacagggacatattttgttttggctgaaataatgacatggaactggcagtgattccagaaaacctttcttctctatcatggcctgaatcctcagccacctcaaaagtcagcgggcaggaggagtctctcgccagttttcttttcatttcaaatgaggctcattgtcctagaaaagtaattaactagcaaccagtccaatgactaaataaaaggaccatccagctgtggctcacacctgtaatcccagcactttggaaagccaaggcaggaggaacacttgaggccaggagtttgagaccagcctgggcaatgtggtcaaattctatccctacaaaaaaaaaaattagccagatgtgatggtgcatgcctgtagtcccagctacttgggaggctgaggcaggaggattgcttgagcccaagaatttgaggttgcagtgagctgtaattatgccactgcattccagtctgggtgacagagtaagaataagaccctgtctctctgtctctctttctctctttttttttttaaaggagtcagctctacaaagatgttgctttctttgatgcaatgcagagagcagagctttggacttggaatcaggagacccggactctgtcattaaatcaactgtgactctgggccagttactttccacttttgagtcttgatttcctacttataaaatgagggagcttatttggatgatctttaaggtctcttttggcactaataactcggtgtctcttttttttcaccttcaccatttcagttgatccaccaaacaaacctgagagatcaggattggcatccaagagttgtctcggccaactctgatgtcatgcttactctgtactagacattgttccaagcattttacgtgcattaactcatttatcttcccaacatcttgtgagggaggcactatagtgagcctcatttgaagatgaggaaacaaaggtacaaagaggttctagctggacctctaaagtcacataataagtaagtggtagagctggagttcacatccaggcagtaggctccaaggtctgtgctcttaaccacattctgggctgcatcttttatagacaaactatgatccagagagattacgagacttggatcacataccaagagagtgttaaagccacattaggattcaattccagggccatcagattccaagtccactggagaaaagatgtatatctctaatctgttaacaaattgctcaactactcagactaatcccaggtgatggatgtctaatgctcaggaaaggcgagtcagtctctgaggcaacagatcccatgggcctgggtagaaaatgcccagtgcttcccagtcccaagtgctggctttccctgtatctgcctctgccaggcaacacttatcaggctcccaatcagcaggagcctccatgctccactttgaacagcctctatgctccagcaatggggcatttgtgaagagtgacttgattaacttttctgaccatgggtataatacagttgcttcagagggcagtggttctgggtgtgatttttacactgtaacattgtatacagtgtcatggataattactatttttttctggtcattaacactcacctactctagtactaggatttcagaccaaggtcctcatgacgcctggatattttagtatctatatccaataatcttttctctcctactgaatatccaggcaaagatgaaatcgttttctttaaaactgtcaaattctgtaaaactcaggagccagttcaagggaacaagcatcttcacaatagatggaatcaagagttaaatgttatagtggcaagcttgtctactgggcaacagacaaccagacctgcttgtgagatggcagctccccagccctgctctgtgacctcatttctgtcaaatgaaaggcagcagcttccagctgattgcagcatagtgttcatcaatcacagtaatagcgcaattagccaccaaggttcaagctgtgtaatatgtgttagtggcaacttgtcctggatttaatcttcctcaacaatccaaataaaatatttaaaaactcttgacttctggctgggcgcagcagctcatgcctgtaatcccagcactttgggaggccgaggtgggcagatcacctgaggtcaggagttcaagaccagcctgggcaacatggtgaaacccccatctctactaaaaatacaaaaattagccaggcgtggtggtgggcacctgaaatccctactcaggaggctgaggcagagaatcgcttgaacctgggaggcagaggttgcagtgagccgagatcgtgccactgcacttcagcctgggtgacagagcgagactccatctcaaaacaaaacaagcaaacaaacaacaacaacaaaaaacacctcttgacttctaaagacgcaaaagtggccaaaagtgcaatacagtattgtgtttatttacatctattttaaatgcatgtgtatctgtaaatacaaagtgattcgtgactcattgtctcctcagtctatagcattattaacttctaggagcagcagtggagtagagtgtactgaatggtcacagactcatcgattatcagatctggaaaggagcttagagaagatctgttccaggctcctattttatagaagggaaggttgacatccaaagaatggaaggaaatctcctaattattctgagagtatcacagtgatggagccaggactaggtcctggatcacctctaagaagacacttagctatttgactatcgactagggcctagcattattaagcactagataaatacagatgaaaaaaaaaatgatccctgcctgcaaggtcctatgatctaatggagatgctgtttctaaaatattattatcccaatttggcagtcaaggaaacagccctggaaaagttaacatgctcaagtcacccactagcatcatttgaaccctcctctgtctgactcatgctctttcaaatttttttcttcagattgtcttagcagaagggtagatgggatataccctctggtagtaccaggctcccaaggattcttagagttaaataacctcagttaattaaatagccacaattgcttggtgaccgaagccttataacatccacagaataagaccattctccagacctgactccccaactcatatcacctgctcctgccggccactaagctccttgcttggatatcgagttttctggagtatcctgaggaatgtttgtttgactttgtttgccaacagtttaggggaaggggaaagaactacaataaccagtgtcctgggatctcattgatttcagattccctgccccaagcctacacccaattacctgccatagttggggaatcaagtagcatcctgtggctggaagtaaatgcaaaacactagtccgtgagatataaatactgttaaatgatggttttttaaggtcctgatccattatatgaagtagacaaaattcaaatttatttattcatttattttctcaacaaatgaatatatattatgtgccaggatacaagtagtggcaaattagacacagttcttgctttcatgaaacgtatagcttcatgatttagtatagacattgtcaaatcatcacccaaatataattacaaagtactctaaaggaaaggcacgtgatgctgtgagaacactcaactgggaaaccggaatcacctttgagaaactgtttcaggggctcttggaagagtctactgctcccaaatatctctgctacccactggccattgctttacattcctcaactaagctttcaccttttagtactaacctttgatgactgatcaaatacaaatgccccaagaagactgaggataggagaaagaatatctctacctgtgaaacattgttagactgcctggctaggagttcattgttgttttctgaaggacgtaaccaaccactccaaaacttacaggcttaaaacaacaaacatgtatcatttcttatgattctgtgggttggctgggtggttcttctggctgaggcaggatggtctaggatagctacatccacatgtctggggtcccagctgagatgactggggctgttgaggcctttctccctgtggtgtcatcctccagaaggctgcccagatttgtccatatggtagcaggagtttcctcgaagcaagagagggcaagatccaacacagaagcacttttcaagctctgtttccatcacatttgccaatgtctcactgatgaacacaagttccatggccaagtccagttttaagaaatggagaaatagggcttggctcagtggctcatgtctgtaatcccagcactttgggaggccaaggcatgcggatcatttgaggtcaggagttccagaccagcctggccaacatggtgaaaacccatctctactaaaaatacaaaaattagctgggtgtggtggcgggcatctgtaatcccagctatttgggaggctgaagcacaagaattgcttgaacccaggaggaggaggttgcaatgagcctaaatcgcaccactgcacttcagcctgggcgatagagccagactcagtctcaaaaaaaaaaaaggggagggggaaatagatgccatctctttatgggaggagctacaaaatatggtgaccaatttttcaatctaccacaggaagcaccctcagtcctctgaaactaagtctggtagatgtcctggggtcttaaaacatggctccgatgatatcaccaaagacaagtggcaaaactgtatagggcagggcagtcttatcatttgtttaatagtgatccaaaggatttactttggaggaatcaagacactcgagatgaagaagttttgatgcttgttaaacagtccatttggatacctcttagctatccccgagggatgaatctgacttctcatttcacaggattcaccgtagataatggttgtaattcctaccggaagttcctggccagaagcccagcagaaagattcagtatatatagaaaagatggctccaagaacagttgggccttctgttctaactgtacttccttctttgatgtactcgtctagtcccgaggctttagatgccaagtctttgataataacgtgtatctaagtgcctactggacattttcatgtctcaaacttaacatgtccaaattgaaactcttgattctgcccccaaacttgtttgaaccccagtcttcacagaaaactcatccttaattctttgatttttctctttttctcagcctccttgtctaatctagcagcagatcctagggttttacttctaaatatatctcaaatctgatcatttttctccattttcattggcatgaccttggtccaggccaccattgttttctgccctagagagctaccacagagttcctaacatttccctacttacgtaattactccactctagtccattctgtctcacaggagtaacattttttatatatatatatatatatatatatatatatatatatatatatatatttttttttttttaatagagacggtcttgctatgttgcccaagctggtttcaaattctggcctcaagcgatcctcttgccttggcctcctgagtcactaggattgtacgtatgagccaccgcatccagcctcaatggcaatctcttaaaaatctaaataaatgaacggctcagtaacactgaggtttacttcacacaaaaacaatccaaaccttggcaagacggtgaaaccctgtctctacaaaaaatacaaaaaattaactgggcaaagtagcctgcacctatagtcccagctacttgggaggctgaggtgggaggatcgattgagccctggaggtcaagaatacagtgagccatagccatgattgtacactgtgccactccagcctgggtgacagagcaagaccctgtccccctctcaaaaaaaaaaaaaaaagaaagaaagaaagaaaaaaaagaagaaaaggaaagaaatgaagagaattcagagacttccattattattaatacctattttattgattctgtttctagccctgagtccgctcctaacttgctataggatctctggtaaatcatttcctgtaataagcagctgtcacctctctccttgtttcttccagaaatagtaatctcttctttagtagtactactactccctaacccaaaccaggtgattctagtgaagactgtcaataaacggagcatgtgatcaagcagggcccatcagaatccttccctaagatttttataaaaagctggacctattctttttccatttgagtggcaaatatttgaagatatgaggtctaaagctgtgatggcttattctccatccctgtgtaaattctggtctatagtaagcgaaaacaaggccattaggcagagggcagcagagacataaggtgagaaagagtgtggtctctggttttctagaccctgattctggtttggaggcttggctgatcacctcttcctttgattctgatagaaagctcaatgtatctttctaataaaacccccctttgctttgcttgttggagttaggttcttatcccttgcaaccaaaaatatattgtctcttcttttgttctcagttttctcatttatatatccttctagctccaaagcacagaaattctaaaacaaacaaacaaacaaacaaaaacaaacaaaaaaaacctgggtcattcagaaaatcccactgatatagactttctgatccagaatgtataatctgaaaagaagcctaccctcgtctccatcctctcttcttgtacctgaaggaacgaagaagagggatttctcaaggtgagaagcagttctccatggacactgatgacagcacaggcaaagtttcctatgactagggatcactgtccacacagagtctggcttcccaggtatccagcaggtagacaaaacagctaactccactgccactcctttctccacatccgttcctatttctcagccatctcagtgacatccgccatcttgagagtcaactactgactggactgagttgtgtggtatatgcttctgtttacttctcttctgtcttttttaagtggccaaatagcaaacgcttaaataggaaatctctgggagacttgaataaaagactttgcttggtagaaaatcatgtcacagaaaggctaatagacagcaaagtaaatcagcaagtccctgagcagtaggattaggattcctgtctcctttcagattcaaatgcatctgtttctggggttaacagtggactgttaagaggctgtgcagcttgggttaagtcattcttatctctgggcttcaggagcttagaccagatagtttctacaggctctcttggtgctgatgccttgggattctgtggctgttttctgtaagatctgcaagggggaaacaggattttggcagcaatcctttcattactaaagcttcctttcttttcgggtacagtgaaaagagccaaggctgtgtgaccccctcatcacttagccaggcgtatggtcctggtttctgaggctgccagaaagcatcttagcaatttgtgtttggatggtccatgcctgactattctaggctggaggttcctaaagagtaacaagaggaagagaaacaagaatctctgacacttgttgagaatagagcacagtcccatttgtttgaaaagagacaccaggcagccatgtttatgtgccagaaatgcattccacctcaaggaggacttaatttatggacccgtgtgtgccaggctgagctgggcaagatctttctcaggacaaactctgccatgcagctaaaagcctggaaactaaaggatttcatgtagtaaactatcttccaacccctgtagacatcagaccacaggatgaggtttcagaaggtcataaggcagaatagttaagcctacagggcttacagtctgacagacctgggttcagttcttgggtcttcatcactagttttgtgacttcgggaagatgactcccggagcctcagtgagcctcagttacttcatatgtaaatgaagtaatactatctacttcacaaggctgttgaaaggattaaatggagaatgggtgtaaaacccttagtgcagtgccgtgcacacacagtagatgccgaacgtgtgatgttggcactacacaatgtgtaatcccaatcaggcagagctaggcaggcaaatctaatccaggatctttgtaaggggactgagaaccagagactggagaaagccagtgtaaacaccatgagcaaaggagcaagagaaggggcattgtgtaagtaggagatggagcttgaacttactaagtggatcagggtagaagaatccagtcaggaccaagggaggagagtccaggaaaatgccatgagcagctctgtagcatgaccttgttgggctgggttaaagtagggtctgccaccagtcatgtgacagaaaggtacctcatgcacttcctccttcccccagaaatcagcctccaggagtgaggaatgagcccagaatgagagtttagagtgctccagagcctttgttagaggtgccctccgacattcagaaaaccaggattccagagacctgggtttgagtcctgactttgcagcatactaactgtgtgatcttgaaccaacatattttcacctaatgaggctgacaatcttccctacttcacaaaatagttatgagagtcaaataaaagtacattttagaaagtgaaatgctgtggacatttaaggtggagccactgtgagagtctagggggatagatggtattcgtctcagaatgaaacgaatacacccctctcagagccctttccaaggatcccctccttctttcagctccttccctccacctcaatacacactcctgtcccaggaacctaacctcatctagaaataccagggccagcatgccttacacctagaggtttggttggcttcagagaaacttctggaggctaaaagcagccaagaagaatcagccactacatgctgggcctggatgaacagagcagtgagctgtgatggggctggggctggggcccaggaggagcaggcaggagagtttgtatgcaccgtgattcaaatattataacaaaaatcatcgatcatgtgttaggcactttacagttcccaaagcactttcccatccatgccctgatgatctttgacacaacactgtgatgtgggttttattatttccagtacagatgaggaagactgaggcctgcatcagtgaagcaacctatccaagactacatagagaaggcagtaaatggcagggttagtctcagaacaggggagggtctgttccccccgcagtgggcagtcctaattctgaacttcacctatctgggggtgatagaggggaacaagaggaagcctgctgaagagaaaacctaaacatctgttttgtctacgtatgacttcctctgcttgtgggagagaaggaaggaaaggaacacattgttgtcagccccacaaccccaacagaattaaaccctggagcaggttgaacagcagaggcttccctcagatcaaggagccaggagcagatgatctatctctgtggccacacagagagatgtcaccttatgcaatttgcatatcatattcaattcccccaactgctctttctaatttattcaactggggaccaggctggtctcatgccaacctaggagatgtaccatagcagtatgagcagaattcctcaggaggaacaattagcaaaaactgcagttgcctctcgataggcctgagcagagagaggaacaatagctctcacgtctctcctcatcagattctaactaagcagatgttctcatgcttttttcttcttcctatgttctgtatactgacacctcttctcagtggcatatgaaatatgaaatgtcatgtgttgtgagtttgtataaatataaaggaatatatatacacagtagcaaaagagaagatctcatttacaaatatctatggtgtttccttgttctgtgttgatctgttttattgatacaaactgaattttcttaatgtatcttctatctctattatagtggcaatgatggtatatgcattaaagttcttctgaattgtg

SEQ ID NO: 25282 - DNA, 1283 bp, Homo sapiens
cctggatgcggccggagcggagcagtgctggagcgggagcctcagccctcaggcgccactgtgaggacctgaccggaccagaccatcccgcagcgccccgccccggccccctccgcgccctcccgacgccaggtcctgccgtcccgccgaccgtccgggagcgaacccgtcgtcccgcactcggagtccgcgatggcttcagtgacagatggtaaaactggagtcaaagatgcctctgaccagaattttgactacatgtttaaactgcttatcattggcaacagcagtgttggcaagacctccttcctcttccgctatgctgatgacacgttcaccccagccttcgttagcaccgtgggcatcgacttcaaggtgaagacagtctaccgtcacgagaagcgggtgaaactgcagatctgggacacagctgggcaggagcggtaccggaccatcacaacagcctattaccgtggggccatgggcttcattctgatgtatgacatcaccaatgaagagtccttcaatgctgtccaagactgggctactcagatcaagacctactcctgggacaatgcacaagttattctggtggggaacaagtgtgacatggaggaagagagggttgttcccactgagaagggccagctccttgcagagcagcttgggtttgatttctttgaagccagtgcaaaggagaacatcagtgtaaggcaggcctttgagcgcctggtggatgccatttgtgacaagatgtctgattcgctggacacagacccgtcgatgctgggctcctccaagaacacgcgtctctcggacaccccaccgctgctgcagcagaactgctcatgctaggcaaggcccaccttcctgacctcccctcattgtggccccacacccagtctgcttctccctgttacacactgtccgctctcagcccactctccctgttacacactgcccacactcagagcagagctttggacttggaatcaggagacccggactctgtcattaaatcaactgtgactctgggccagttactttccacttttgagtcttgatttcctacttataaaatgagggagcttatttggatgatctttaaggtctcttttggcactaataactcggtgtctcttttttttcaccttcaccatttcagttgatccaccaaacaaacctgagagatcaggattggcatccaagagttgtctcggccaactctgatgtcatgcttactctgtactagacattgttccaagcattttacgtgcattaactca

SEQ ID NO: 25283 - DNA, 8888 bp, Homo sapiens
agtacgcgtgtgcggcgccaggagaggacagctccagtgctgatgttggagccggttagcgaaccccaagagtgcagagtgtggagcgtggagcgccgggactgtgcacgcttgaccggaagcccagaccagtgcggtcctagccagagagaaaggacatttgccaacaatgagacacgaagcgcccatgcagatggcctctgcccaagatgccaggtacggccagaaagactcctctgatcagaactttgactacatgttcaaattactcatcatcggcaatagcagtgtggggaaaacatcttttctattccgttatgcagatgactcctttacatctgcattcgtcagcacagttgggatcgatttcaaagtaaaaactgtattcaaaaatgaaaagagaatcaagcttcagatttgggacacagcaggccaggaaagatacaggactatcaccacagcctattatcgtggagccatgggctttattttaatgtatgacattacaaatgaagaatccttcaatgcagtacaagattggtcaactcaaatcaaaacatactcttgggacaatgcccaagttattctggttgggaacaagtgtgacatggaagacgagcgggtcatctcaactgagcgaggtcaacatttaggagaacagcttgggtttgagttttttgaaacaagtgccaaggacaacattaatgtcaagcagacatttgagcgccttgtggatatcatctgcgacaaaatgtcagagagtttggagactgatcctgccatcactgctgcaaagcagaacacgagactcaaggaaactcctcctccaccgcagcccaactgtgcctgctagtgtccccgtgcacacaggcagctccagggggctctggttgccaacaaacagcatttgtaaatggtctattagccttcatttatactgcctaacaattatttgaaggaataaattgatgtcaatggctcgtacgcattcaattcttgggagctttcctgtttaatatgtggcaaatatgtgatcttaaatttataaggactatccatctataaacatctggtacctgcatgtgacttgttatttatttgtctgctaggctctttttgtttcaaatttgttctcagactacttctgggacatcagactataatctcactacaactggcttttgtcccattgattcaaattatgctattcacttgtaggaatgatgaccaaggaattgcttgtgtgtgtgtgtgtgtgtgtgtgtgtgcacgcatgcccgcatgcgtgcagaggaagaagtcacaagacttcatttgctttactcttagttgaaaatcaaatggaagtttttctcatgattagggacgctgtcacgagtctggtcagtttactgttgggaactgtgtctttatttcactgttattaataactgagatcattggcctataaagaaattgaaatgttgtttttaaggtccttgcaattttcctaagtcattaatattacctgactggggctatttaacaataatcttcgtttacacatttaaataagcaagtatctacccaggactgctttttccactgatccttcccaattctgtgaatattcaacatcattgaacagattgagacatatctactgaatgccagttatgcaacaagcattttaaccaagaagggtatgagtagctatggaattccaaggtccaagcccccttatttttcaatgacttgccttccccaacccccataatgcacaccaccaccaccatcactttctggaaccatcaccaactcttggactagagcttatgttgaagcttgttagggctcctctttccgtaggatgtagacttgcctccccaaacacggccatcttctcaaacctcagctaagttcttttacctgtttagatgctatttaaatcagatttcaaagggtccccagttgagaaaaaggaaaattttaatctttaatcatctttttaagtccagatgttcataaattctaaagcatattcctattacgtgaatgcttaagttacacaggaaacattctataactgtagtatttcaatttcagaaatatttaggatccatagcaatttaaaagagggaggaaaccactggagcattctaattttgtatcacaaacttcctaaaggacctatatgaataaagagaaaacaacaaatcctaccagctgtacagagagcaacagggaaatttggcctctgtatcactgtccagcattatttaaagctaggatttaggaaggaagcaggaattatttggcagatttggaaggatagtttcgttaagtgaactttctacttttttggtggttatgtcaaagaatttttttcctcttctcaaaaatagagaggcttcccatgaaagtattggatgcaaatgaaacaggcatacatctaaagatatctttggagaataaatccttacaagtcacagaactaggtcacacacattagtaagtcaaaagttggaaattaggggagagagcatttggaatgctttaagcatttccatgttatttctcaccttcctagttgaagatccactaatcagtagtacatttctactttggtgccctacaaagcaaaccttagcatagtaaagacaagaaaacattaatgttttattagtttttaatggggcaaccaacttcaaaatcacaggaattacagtgacgggagagaaagaagcaggaggcataaaaacagatttgtttgtagcagtagtctgtttgtacaatgttataatatttctgtaacttgggccagaatgtggccatgttaaatgatatagctattaagctcacttttacaatctaaaaggaactaataaagccaggaaacccttctcatcctccttcacagccctcatcccacacatagatgtaaaaagcttagaaagaatattctgatggctttttcagaaggaaggaccttgatgtgtgtattgtggtaaaatgaaaagcaaaatgagacagtatttaaaagtgaaagagcagagttttgctctgctgaaaaccccttccctgaagaactgattgctgttgaagttaattggcccttagatgggaagccctaagccaagctcccacttacacagtgtcaaacatcccgaagtggaaacattttatgccagtcaggggagagacaggcaacaatagcccaaatgtcattgccaagaaacatctgatactttctaatttctaaaccccaatggaagtgaggcctttttcattgattctcagttctgaaactcccaccctgttaggatttccattccaaataattcaatgagaggtttccagagaaacagtcacagagctcaagagaaagaacacttaaatgctcctgctgtaattgcatcaaaaaatccgggttttaacatcaaatttggcaaatggtgggaccaacccaaggttaactaagtgggctttcattggcattgagctatgttacttataaattataacactatagttccaaggtttttcagccttttggccaacacacacacacacacacacacacacacacacacacactataccatcatctatcaatagtctaaatacataaataaatgcaggtcatttttatcaatggcctaactaaatttatatttaaaagaacaagacttttaaaaagtacatactcctgttggtttgtaagttatacacatttatctcttgtctttgatttaattaaattagtgttttaagtatgaatttattttcctttgctactcattacctgaccactttcactcctctagatacccttaggaataaacctgaactgttccaaatcgattcttccaagagctttggtgttggtaccttcctttcttttcctaatgcaactgaaaaattagactgaaaattatttgacttaaatagccatcctcagagtgaatcagcatttcagtttttggagatggggatggaagtagaaggtgcacaaagcgtcctaagatggcagtttgaatgttagcatcgcatctacatgctcataagaggaattgcttcaggacaatgaatcagttcattgttgctgcccccagtgaacagctccaactgccttgatgaacttctaatgactgtgaaagctaggaggttcttctagttcctccttagggtcacttgaagttcagtatttttttgctgcctggtaactaagtgctaagatttttacttggaaagaaaactatgacaatgccttcagttgtagcagaaagttgtggcattgtgataataaacaaaatctacaaagttacaacccaaattatacaagacatcaaaacactcagtaaacaaatatatatatttcacctacttaaatcttattcatattaattataggccttttgtttagtacactggttattttttaaggaaccaatttaaactttcaattttaaatacatctatgctgacgatagactttcgggtatatacaaccttcttcttctcttttaaaagttaaatacattccactattaactgaacttccatgaagcaacattaattttagagcatggtagtccataatcagtggttcattgtgatgtgctttatccaacatgtatcttagtgcatggttgaggatgtactatgtgatattttagttaacagtgtggcatttgtgggactatattaaaagcatatccaaactaccaagctataccaagctgaggtaggtaacacctgcatgtgaaaaactgtgatatgaatcttatttataaaaaagtcataactaaaacccttctagaccaaaaagttactgtgtgtttgttaataatcttcatagtactactggaatgctcaatcagttatttttggtgtggcatacttcagagctggcctgtccgtctgaagaaccctttctctcacaattacagtttgcatgactagaacccggaactctgttcctttgcgtgtatagtcacttagtgtgctgtccgggtgccacatgagcaactacacccatgtggcctttctgtcactccctggaaaatgcaacctctacagctctgctcagctctgcctgtgtgcattgattaccttcgctttagtagtttgcctgtaaaatggtgaagtctttctgatatgctgaacctttgagccagcttttgggagttcttcatattttaggtgaatttttgaccaaagtcaattaaagacataaacctgttttatatcatggaatttactgggccaaattaagtaaaagatgaagtttatgaccagaataaaaaagcctttacccctgcacagcactgtatctaaagggctctaggttgtagaaatatagtaccccctaacagggaaaaaccaagttgggggatttatctaaaatgtatctacctattgttactggtatttcacaaataatttttttcttaaaaatatttacagaaatgcttgacactccggtcaaataatatttccctttgatagattgaaatatttgcttttagattacacatacagtgctgcccttctcaacagtcactcacacgctcactcgcctgtacaaaggtatcaggcaaacactgatacttttttttaagaaggcaaaattccatctatggtgctttctcagtgctagggaaaagggagcttttactatgttccagctataactcacatcttacttataaggtccataaaatcggttcttcacactgatttcgtttgattagtctgtgcatgtaattaatttcctccaaacagagagagtggaggggaaataaattttgcaagcattctagataacagaaatgagtcattttaaaacctcactcagagctcgagtgttaagatcagaccatctagctagtggacaaattgaactttctatttgcagttctcttttactttctgactttcttttaaattactgcagtttttcaaaacactatcctcatggaatgacaggaccaagaatagaaaatgagactcaaatttcaccatttacttcccatcagcaaccattactggtggagtttcaaacagtcattacttgctgaaatgaggtttgaggttacctgtgtatttcattcacctgtgttaatatttccttcatcgtggacaagtgagagttggctgtggctttatttcttgaggcaaattattttgcattcatgttatttggggctaggtattgcttaggttcgtgaatgctgttcttacagacacagatggtacctgagcccctcagacacctgccctttcagggacgtgagcatgacttacatctgtcaagtggttccatacttcttgtaaaagtaaagtttgggtattgtttgctgtatcaatatgatggctttccatgcattgtctcattatccctaggatacgtgctaaaggaaaactgtcctgtaattcctgttaatatattgttaatgtcagacgtgatgtgataccgttagactgtccaaatgtacaacaatttaatggtgtttgtagaactgatatgtcttaaatgttgcatgaaatatgttataaaaatagatttgttttctattttcaacacctcagaattgagggttcatgggccaataagtgcaatatttaatgactcactcagtgtatataaactagtatgaaagagtgaattataatgaatgtgtgagatgctttgatagctgtgtgacttattcaaatgattttcttgtagctgtatttgtctagtggtgcaatttatacagtaaatatcttattggtgtcatgtaaaacccctctgtgcctacttcaaaatacttttttcttataaaaccaaacatttagtatctggaaatatgtgtcaattttatctcttagaattgtggattttattgtcaagacagaatggctgttcatttattttataaaagcatctccttctataactcaaaattttctttaagtgtcatataaaagtgtacattttacttttaagcaactaatttagatacctaagaaaaactatgtgcattaggaaaagtcatgtttttcttctcagaaaggttgatcacatgacatgtctactaagaattttcacctctgtacttgtatgtatattttattgttactcaatcttgtattttatttacaaattcaacactgtcaaccctgggaattctaaaataccaatgtatttttaggttgtagctaatgttgtattcactttcaattctcagttgtccacactggtgatataagaggaacaaatcagaatcattaaatactttgtaatgccatcataaactcatatattcatcctcaaactcccttgtttaatgctaattggtggcctggaacttcactgagatgcaaaatcaagaactgaagcctagttgctagataacgaaaagctataaatgtttatgtatgtgaattttaaattagaataaccgtcttaaactcctacttgccatttctaaggcaaagcattcattttaatattgtactttgccttttcattcagttagtggagtaagtcatgaaacccttaggaagaaaaacaagttatgacttattcactaaaattgatgcaagacagttggttctagatgaccatggccatgtgttcatcatataaaaccttcagttctctctatggtgcttggctggagattgacatgtgaggatgtgccaatcatattaaatggatttggtctatgtgggtgatatgtggcctgaatgtaactgtgatagactgaaatttgttcttagctctcaaaatccactgaagaagtcaagtgaaggtgggtaaaatagggagattagtgacaactttgtgccaaattttttaaaaaatggaagcaggtagccaatattagaatgataatttaagggtgtggttgaattttagttagttgtcacatagttattgaacctcatatgctcagtgctgtgggaatcaaacatggaagaggtatggctcctgcccctaatgagaacaagggggaaaaatccagatataatctaaatgctaggttatgtcagggtataggaacacagagaatgggggacctgtaagaactggaagagtcagagagggctccattgaagaggtcaaacataattccggaaagaattaggtagtgaggagattgtgccaggaaaataagtgggaaaggccacagttatgtttcctttgaatggaagagagacaaagctatcagctatagatcattgttttcttaagacagccaaactggccctttgaaaccattcaaattaccccagtttagctccctaccttttagtctccgtgaggaagacaagctgttgcattatcatattcctctgtgctgagcagctcaagactcagccacaatatgcaaattgctttaatgccatattacggcagttgatttagacatttgccagtgcaccaaaccatgagagattgtccgacctaatgccacctggcagatgtgtacccagagatttttctgtagctccatgtttcccataaagggcattggaaatgcacagatgaagatcttcctttggaaccaggcacatttggccccttctcagtgactgcactgtggaactcttcttaagaaaatattgaaaacagcttaatgctttcatatagtgaccgacatttagttgaaaactactgctgcatagcaaatattgtgactcttcatgtgtccacaggagctcttgtgtgggtttaaagctatgaagtgtattcacattgtgaagttttaattatctttattgaaattaattgtgtaaaaatggtatgtgctctattaggtattcagtttgtatgtgaattctataaagaaagtggtttttgttctttgagtttgttttatttcttgaagattacaataaatatctaagagactata

SEQ ID NO: 25284 - DNA, 1029 bp, Homo sapiens
cgcacaaccttgctggtctggcccaggcggggggcggggccagcacgatgagcgccccgggcagccccgaccaggcctacgacttcctgctcaagttcctgctggtgggcgacagggacgtaggcaagagtgagatcctggagagcctgcaggacggcacggccgagtccccgtacagtcacctggggggaatcgactacaagacgaccaccatcctgctggacggccagcgggtgaagctgaagctctgggatacgtcggggcagggaagattttgtaccatattccgctcctactctcgtggtgcacaaggagtgatcctggtctacgacattgcaaaccgctggtctttcgagggtatggatcgatggattaagaagattgaggaacatgcccctggtgtccctaaaatcctggtggggaatcgcctacatctggcattcaagaggcaggtgcccagggagcaggcccaggcctacgccgagcgcctgggcgtgaccttctttgaggtcagccctctgtgcaatttcaacatcatagagtctttcacggagctggccaggatagtgctgctgcggcacaggttgaactggctcgggaggccgagcaaggtactgagcttgcaagacctctgctgccgcaccatcgtgtcctgcacacctgtgcatctggtggacaagctcccgctccccattgccttaagaagccacctcaagtccttctccatggctaagggcctgaatgccaggatgatgcgaggcctctcctactccctcaccaccagctccactcacaaaaggagcagcctctgcaaagtgaagatcgtctgcccaccccagagcccacccaaaaactgcaccagaaacagctgcaaaatttcttaaggaaggcaccaaaaggaaacaagctggaatcgctccaggaaaaactctgaatggttacacctggaagagggaagatgcattctagattcaaagaaatacgttttcagtttctcatgggaacaatgctgcttgggaatgtgtgtga

SEQ ID NO: 25285 - DNA, 2966 bp, Homo sapiens
gccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttggtggtaaatatgtaaagttacaaatatgggatacagcaggacaagaacgattcaggtccgtgacgagaagttattaccgaggcgcggccggggctctcctcgtctatgatatcaccagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgttcatacagtggcatttgggacacaatcgttggaacctgaagaatctgaagttttttttaccaccatctttttctactctgtatggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcctcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacaccatatatccttctgcatcctttggccaataaaagttgctggagaaccaaaccatggtggttcttaatcaggctttgcctttagggagaatgaggaggagagataattgggtattgttcaggctagtaataaatgtcatgtttctatttcccgcaactcattaagttttcaggaagctcttaatttagatttctaggaaagtaattattcagtcttcctagaaaaagattataaagaccatttaaactggagattgtaatttattcttttacagtccagcatttaagtgaaaatgagaacatcacaatttgggaatctgtaatggttttgttgaaaacattacttgtggcttgtataagagtggctgaattcaagaacattgattcttagcagatcaataatagtatttaaagaatctgatgctaaaattagaaacctaaa

SEQ ID NO: 25286 - DNA, 2536 bp, Homo sapiens
gaagtgacgaagtggcgcagttcgctgcgtgcagcgacgtggcggcggggccggcaccgggcagcggaagtggctccggcggtgggacttgagtgtttgtgttttggttcgtgaaggagccggcggctggccttaggggaggaggcagagggaggaggaggaggaagaattagtcggaactccagcgccggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatacgggaaataaaatatgccagttcaaactagtacttctgggagagtccgctgttggcaaatcaagcctagtgcttcgttttgtgaaaggccaatttcatgaatttcaagagagtaccattggggctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagtggtataaaaagcaa

SEQ ID NO: 25287 - DNA, 1443 bp, Homo sapiens
aggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatacgggaaataaaatatgccagttcaaactagtacttctgggagagtccgctgttggcaaatcaagcctagtgcttcgttttgtgaaaggccaatttcatgaatttcaagagagtaccattggggtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaa

SEQ ID NO: 25288 - DNA, 753 bp, Homo sapiens
agtcggaactccagcgccggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtaaccgaaccgcccctcctcctgcgcagcgggggcctggaccccaggttatccgcggtccccagcctgtccgcggccctgccggtactgagaccccccaccccttctccctcacgcgcagcagtgccctggaccagagaactatcgaacccggcgtcttgttctgccagccctggtgactcatcctccaggggctctggagaccgggatttggggactgactgagggagcgacgggtgtcaccctttcccttctcaagatggcgccgtggaaagtgtactggaggccgcggttccgcctggtctccgtcctggcagtcctgggggtctcggtcaaagcaaggtttctttacctccagaaagaagaatattggccccttgaattctggaagttcattgaagagtctgaaattagggacttatttcaaatttggacatggctagtcgaggcgcaacaagacccaacgggccaaatacgggaa

SEQ ID NO: 25289 - DNA, 3362 bp, Homo sapiens
aatcgagctattggctggagccccgccccagggcgaggaggagaaggaggggcaggagggtttggttgagctgcagctgtttgtctgttcgacacaggcttggggccgacgggggagacggagccccaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtgaaggaactacagcgacaggccagtcctagcatcgttattgccctggcagggaacaaagctgacctggccaacaaacgtatggtggagtatgaagaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaa

SEQ ID NO: 25290 - DNA, 1530 bp, Homo sapiens
gacacaggcttggggccgacgggggagacggagccccaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctg

SEQ ID NO: 25291 - DNA, 596 bp, Homo sapiens
cagctgtttgtctgttcgacacaggcttggggccgacgggggagacggagccccaggtaacactggatcaacaaaatgaagagctgagccaagtggtagaactctcatttcaagattttggtgacttgggtttaaacagagttggagagggagatgaaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtg

SEQ ID NO: 25292 - DNA, 569 bp, Homo sapiens
gacacaggcttggggccgacgggggagacggagccccaggtaacactggatcaacaaaatgaagagctgagccaagtggtagaactctcatttcaagattttggtgacttgggtttaaacagagttggagagggagatgaagtgcggatcttgaaatcaattccgatggtggagatgagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacg

SEQ ID NO: 25293 - DNA, 3322 bp, Homo sapiens
gctcgtacttgttggtgacagcgcccaaagagactcgcctttctccagaggattggtggatgagtgcacatatagcccaccctcgaaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtgaaggaactacagcgacaggccagtcctagcatcgttattgccctggcagggaacaaagctgacctggccaacaaacgtatggtggagtatgaagaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaa

SEQ ID NO: 25294 - DNA, 1671 bp, Homo sapiens
agatccggatccggagcggctgaaaggcggaagtggaggccggagcctgggacaccgccggcggggagagaagcggatcccgtccgagccccggccccaagtaacgccgccgccccggagccgccttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctcacaa

SEQ ID NO: 25295 - DNA, 1771 bp, Homo sapiens
gagcggctgaaaggcggaagtggaggccggagcctgggacaccgccggcggggagagaagcggatcccgtccgagccccggccccaagtaacgccgccgccccggagccgccagtctcgctctctcgccaggccggagtgcagtggcactatctcagctcagtgcaacctctgcctcccgggttcaagcgattctcctgcctcagcctcccgagtagctgggactacagttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctc

SEQ ID NO: 25296 - DNA, 1167 bp, Homo sapiens
gaagtggaggccggagcctgggacaccgccggcggggagagaagcggatcccgtccgagccccggccccaagtaacgccgccgccccggagccgccaggcttctagagataggctcctcatgtgtctgcaattccaaaacttaacaaaaacaaaaagttgagcctctgaagctgtcactaaccaagtgattcagatgtcgggactggaacaccagctgttggggatgcaggacttggtctctgccctcccacacctcctgcctcttctttctctccatcgccccatctctgccagtagagaatggaactgagttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggagggg

SEQ ID NO: 25297 - DNA, 500 bp, Homo sapiens
accgccggcggggagagaagcggatcccgtccgagccccggccccaagtaacgccgccgccccggagccgccagtctcgctctctcgccaggccggagtgcagtggcactatctcagctcagtgcaacctctgcctcccgggttcaagcgattctcctgcctcagcctcccgagtagctgggactacagttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatct

SEQ ID NO: 25298 - DNA, 583 bp, Homo sapiens
aaacccggctcagcctcccaagtcctaacctgctagccacgctggggaaggttgtgggtacctcgtgtggatcgtggctggcgttgcttcagattcttctttcctctgggtctgcaaccagctagaagcctggatagtcctgctgtgagtctgtcctctgtttctgtgtgctggcagtggttttcccttttgaggaagagctgtgttcttgagcctatggttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcg

SEQ ID NO: 25299 - DNA, 551 bp, Homo sapiens
gtgggtacctcgtgtggatcgtggctggcgttgcttcagattcttctttcctctgggtctgcaaccagctagaagcctggatagtcctgctttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagc

SEQ ID NO: 25300 - DNA, 3134 bp, Homo sapiens
agcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacaatcaggcttcagctgtgggatactgcgggtcaggaacgtttccgtagcctcattcccagttacatccgtgattctgctgcagctgtagtagtttacgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgatataaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagattttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaacttatacttaaagatgggatggagttgtaaagtgcttttataatacaatataattgttaaaggcaagggttgactctttgttttattttgacatggcatgtcctgaaataaatattgattcaatatggca

SEQ ID NO: 25301 - DNA, 3085 bp, Homo sapiens
gctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgatataaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagattttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaacttatacttaaagatgggatggagttgtaaagtgcttttataatacaatataattgttaaaggcaagggttgactctttgttttattttgacatggcatgtcctgaaataaatattgattcaatatg

SEQ ID NO: 25302 - DNA, 3089 bp, Homo sapiens
gccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacaatcaggcttcagctgtgggatactgcgggtcaggaacgtttccgtagcctcattcccagttacatccgtgattctgctgcagctgtagtagtttacgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgatataaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagattttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaacttatacttaaagatgggatggagttgtaaagtgcttttataatacaatataattgttaaaggcaagggttgactctttgttttattttgacatggcatgtcctgaaataaatattgattcaatatg

SEQ ID NO: 25303 - DNA, 522 bp, Homo sapiens
atccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagagaataggttcttgccatgttgcccaggctagtcttgaactcctagactcag

SEQ ID NO: 25304 - DNA, 577 bp, Homo sapiens
agcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcgg

SEQ ID NO: 25305 - DNA, 1102 bp, Homo sapiens
gttttccccagaggcttggccctgcgaagtgctgatgtcgtggaagttggaaagacatctttgatcaccagattcatgtatgacagttttgacaacacctatcaggcaacaattggcattgactttttatcaaaaactatgtacttggaggatcgaacaatcaggcttcagctgtgggatactgcgggtcaggaacgtttccgtagcctcattcccagttacatccgtgattctgctgcagctgtagtagtttacgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattg

SEQ ID NO: 25306 - DNA, 828 bp, Homo sapiens
ggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacaatcaggcttcagctgtgggatactgcgggtcaggaacgtttccgtagcctcattcccagttacatccgtgattctgctgcagctgtagtagtttacgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagaga

SEQ ID NO: 25307 - DNA, 758 bp, Homo sapiens
actcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacactctttcgacgtgtagcagcagctttgccgggaatggaaagcacacaggacagaagcagagaagatatgattgacataaaactggaaaagcctcaggagcaaccagtcagtgaaggaggctgttcctgctaatctc

SEQ ID NO: 25308 - DNA, 1104 bp, Homo sapiens
ttgttttccccagaggcttggccctgcgaagtgctgatgtcgtggaagttggaaagacatctttgatcaccagattcatgtatgacagttttgacaacacctatcaggcaacaattggcattgactttttatcaaaaactatgtacttggaggatcgaacaatcaggcttcagctgtgggatactgcgggtcaggaacgtttccgtagcctcattcccagttacatccgtgattctgctgcagctgtagtagtttacgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattg

SEQ ID NO: 25309 - DNA, 569 bp, Homo sapiens
gcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattgg

SEQ ID NO: 25310 - DNA, 3077 bp, Homo sapiens
gcgcactcagcaggttgggctgcggcggcggcggctggggaagccgaagcgccgcgcgtgagagatcccggatacatctgcggtttgggctccgccaccctccgtctctctcccgcaggtctctgagccgggtgcggaaggagggaacggccctagccttgggaagccaaagcacacccctggctcctgccgacaccgccctccttcccttcccagccgcgggcctcgctccgtgctcggctactctgccgggaggcggcggcggctgccagtctgtggcgagccctgctgccctccagccgggctcctccagccgggctcctccaccggcccttgcaggggcgcagagagctcggcgcccgcccttccgctcgcctttttcgtcagccggctggaggagcatcggtccgggaggtctctgggctgaggcggcgacagctcctctagttccaccatgtccgcgggcggagacttcgggaatccgctgaggaaattcaagctggtgttcctgggggagcaaagcgttgcaaagacatctttgatcaccagattcaggtatgacagttttgacaacacctatcaggcaataattggcattgactttttatcaaaaactatgtacttggaggatggaacaatcgggcttcggctgtgggatacggcgggtcaggaacgtctccgtagcctcattcccaggtacatccgtgattctgctgcagctgtagtagtttacgatatcacaaatgttaactcattccagcaaactacaaagtggattgatgatgtcagaacagaaagaggaagtgatgttatcatcacgctagtaggaaatagaacagatcttgctgacaagaggcaagtgtcagttgaggagggagagaggaaagccaaagggctgaatgttacgtttattgaaactagggcaaaagctggatacaatgtaaagcagctctttcgacgtgtagcagcagctttgccgggaatggaaagcacacaggacggaagcagagaagacatgagtgacataaaactggaaaagcctcaggagcaaacagtcagcgaagggggttgttcctgctactctcccatgtcatcttcaacccttcctcagaagcccccttactctttcattgactgcagtgtgaatattggcttgaaccttttcccttcattaataacgttttgcaattcatcattgctgcctgtctcgtggaggtgatctattagcttcacaagcacaaaaaaagtcagcgtcttcattatttatattttacaaaaagccaaattatttcagcatattccggtgataactttaaaaattagatacattttcttaacatttttttcttttttaatgttatgataatgtacttcaaaatgatggaaatctcaacagtatgagtatggcttggttaacgagcagtatgttcacagcctgctttatctctccttgctcttctcacctctcccttaccccgttccctatttccgtgttcttacctagcctccccccacttcctcaaaacaaacaagagatggcaaagcagcagtccgaccaagcccactggaattatcctttaattttacagataccacttgctgtaggctgtggaccaagatgtccagaattattcttgagcactgatgtaaattacttagatcttctttgaggtcagaattcagcgatcacggtaggcagtgcttgaatgagaaaagcctcctggtgcatcttcaaaatgagtcctaaagaacatactgagtacttataagtagcagaacataaaatgtatttctgactaacacaaatggtcctttcacatgtgctttattagactctgggagagaaaagtaaccaagtgcttcagaacaggtttttagtatttacttcttcatggtaagataatgaagttctaatgaactatttctcccaaggttttaaaattgtcaagagttattctgtttgtttaaaaagtaagaaacctctgtaagcaatagattttgcttgggttttctttcttaaaaaaataatactatgcaggcaagacaccataaaagtttaattccttacagaagaaccagtggaagaatttaaatttggcactacgatcaaaactactgaattagcagaaataacgatatctaaagcttaccagcaaaagaaccctcagcagaatagcaaaaactttgctcaggacatttgaggtcaaattgaagacggaagacggaagacggaaaccggaaaccgttttcttgtaagcccctagaggcagatcaggtaaagcatacatagtagagggaaaggagagaatggaaataaaactgaatattatgcagatttatgccttattttttagcattttttaaggttgggtctttcaggctggttttggtttgtattagatctgtatagtttaactagtgatttagttttatatttaagctacgattaatattttttctttggcgatatttctttgctttttttttttttaacaactttccatttttagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggaagaaaacttcgagttacaggtcaggaaaagcctgctgaatttatgttgtaaacgttacttaacacagtataaagatgaaaagacaacaaaagtatcttcatacttcctcatcccctcattgcaacaaaaccttaaactgggagaaccttagtcccctctctttcctcttcctcctccacttcccacttattgtcactttgtaatattcagagagcacttggattatggatctgaatagagaaatgcttacagataatcattagcccacataccagtaacttatacttaaagatgggatggagttataaagtgcttttataatacaatataattgctaaaggcaagggttgactctttgttttattttgacatggcatgtcctgaaataaatattgattcactatg

SEQ ID NO: 25311 - DNA, 1723 bp, Homo sapiens
ggaggaaggggagagagaggcgcgcgggagggcgtctagggaatcgaggtgccggctgctccttcctcacaatttgcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgacaattttattaagtacatttgaattgtctcctgactactgtccagtaaggaggcccattgtcacttagaaaagacacctggaacccatgtgcatttctgcatctcctggattagcctttcacatgttgctggctcacattagtgccagttagtgccttcggtgtaagatcttctcatcagccctcaatttgtgatccggaattttatgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggagggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaa

SEQ ID NO: 25312 - DNA, 3272 bp, Homo sapiens
ggaaggggagagagaggcgcgcgggagggcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccgcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgacaattttattaagtacatttgaattgtctcctgactactgtccagtaaggaggcccattgtcacttagaaaagacacctggaacccatgtgcatttctgcatctcctggattagcctttcacatgttgctggctcacattagtgccagttagtgccttcggtgtaagatcttctcatcagccctcaatttgtgatccggaattttatgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggagggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctgggggaggaaagtagatagacagaaaatcattaggtaatttaagtactaaattgggcagggctttttagtatcaaatcactactagaccatttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccagccgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggagactgaggcaggagaatcgcttgaacctgggagttagaggttgcagtgagctgagatcacaccattgcgcttcagcctgggcaacaagagtgaaactccatctccaaaaaaaaaaaacaaaaagaaaaagatttttgggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatattctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 25313 - DNA, 1157 bp, Homo sapiens
tgacgcttgcggaggaaggggagagagaggcgcgcgggagggcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccggtgggtgaggttccgcggcgcctggtccagtttctcggcagtcaggccaggagggggtggggaaggtgcgaacagccgggggctcggagctcgcgccctgcgccccacccaggttgcggccgcccggggaggaagcgcgtataggttgagtgcaaagtttccttttttgctttctcgtcagagcagcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttt

SEQ ID NO: 25314 - DNA, 1306 bp, Homo sapiens
gcggaggaaggggagagagaggcgcgcgggagggcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccgtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgacaattttattaagtacatttgaattgtctcctgactactgtccagtaaggaggcccattgtcacttagaaaagacacctggaacccatgtgcatttctgcatctcctggattagcctttcacatgttgctggctcacattagtgccagttagtgccttcggtgtaagatcttctcatcagccctcaatttgtgatccggaattttatgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggagggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgt

SEQ ID NO: 25315 - DNA, 1441 bp, Homo sapiens
agtcaggccaggagggggtggggaaggtgcgaacagccgggggctcggagctcgcgccctgcgccccacccaggttgcggccgcccggggaggaagcgcgtataggttgagtgcaaagtttccttttttgctttctcgtcagagcagcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgacaattttattaagtacatttgaattgtctcctgactactgtccagtaaggaggcccattgtcacttagaaaagacacctggaacccatgtgcatttctgcatctcctggattagcctttcacatgttgctggctcacattagtgccagttagtgccttcggtgtaagatcttctcatcagccctcaatttgtgatccggaattttatgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggagggggtctgggcatctgtggatttttggctactagaagtgtcccagaagtcactgtatttttgaaacttctaacgtcataattaagtttctcttgtcttggcatcaagaatagtcaagttttttggccgggcatg

SEQ ID NO: 25316 - DNA, 2175 bp, Homo sapiens
gtgccggccaatgggaggtgcgctcgggctgcttccggctccgcgctccgctcgccccctcccaaggtctccccgcgactggcgggacgcaggggcgggcgtcggccgcggtgacgcgcagcgggcctggagccaataaggggcgggctcggtgctgatggacggtgctggtggccagtggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaatagtctgctctccccgggaatctctaacatgctctgtttacatcgataaatgcacttaaggaaaacaaacaaattaaagctcatcttaaagtcc

SEQ ID NO: 25317 - DNA, 3748 bp, Homo sapiens
cgagcggcagctgtcaggccaccgaggtccaagccgcacttgctgccccattgaggacgaggaggcagcaggagcagtgacggtgactctaaggagccggattcccggcacgcagagctgacctgcctggcacccgcggccctctcctgtttccttcccattgtgttggcaccctaaaaagaaagaataaaacaacaacaggaaaaaaaggaaaatatttaaattgtgacaaaaacccactgggttctcttggttacaaactccttcccttctggtgctgcaaaaatgagtgggaaatccctgctcttaaaggtcattctcttgggtgatggtggagttgggaaaagttcgcttatgaaccgttacgtaaccaacaaatttgactcccaggcttttcacaccataggggtagagttcttaaatcgagatctggaggtagatggacgctttgtaaccctccagatctgggacactgcagggcaggaacgtttcaagagccttaggacacccttctacaggggagcagactgctgcctcttgaccttcagcgtggatgatcggcagagcttcgagaatcttggtaactggcagaaagaatttatttactatgcggatgtgaaggaccctgagcatttcccctttgtagttctgggtaacaaggtagacaaagaggataggcaagtgactactgaggaggcacaaacctggtgcatggagaatggggattacccttatttagaaactagtgccaaagatgatactaatgtgacagtggcctttgaagaagctgtcaggcaggtgctggctgtagaggaacagctggagcattgcatgttgggtcacaccattgacttgaacagtggctccaaagcagggtcttcgtgctgttaaagatagggagccttttaaaaatgtgccccaaattgatcagtcagtagtgtaagaataactgtgcccctctaagagtgcacacacacgcacacaagagggtaagagacaaggttctgattgtgaaacagagcctttcaaattgaagtgtagattgatttaaaaaaattaaaaattaaaaaaaatgaagctctatcaagccaagtgtattttgcgtgatttctgctatttccccttcttgtgtgtctcaggacatatcagaaaattttagtcctgagacagttaaatattttttaaatcacagtttaaacctagaacccagctgcatgaaggagttaaagagctacaactatttcttaaagtgttccattaatcaactaacaaatgtcactatcagactcttgccaagcagtttctgacatttctgccaaaggggaaaaaaatcagactttgagctgtattacaataaaaataataatgcaaataaggattcctaggcttgaattaaagaagttgtaatgattaggagtgcaaaagtataatgatatacactgacttgtttaaatccttatgtatggttcgctcccatctgagcttttcaaaaaatcccatctcaataagagatactctaatgacactggcaattgattatacttcttgtgtttgaagtcataggatactagtgaatggattatgcttaaatatgccaaccacctttgcaaataaatggttggtctgcttttaattcctaagtctacttttgctgcatagagatgttgcttctctgacaacctcttaccaatttagcaatgctgcttagtatatgaatttggatgcagtgctctctgctcatcatttagatggtcctttgatccaacatgctgggctcatggagaaggcttcataaaagattgggggataatgaacttttctcacaaggctccttaactcaaatatttattgcagaagaaggaactggtttcttatatgttgcactgtatgttcaactagcctaattaggacattgaaagtgacagaagagcagatcttaacccagtgttagaatgaatttcccataaacagagttgtccaacagtggaatggactgccttaatagtgagctccctgcctctgaaaatattcactggatgaccatctgttagaataccataaaaagattttctgtgctggctacatgttcaatataaagtcctttctggctctaagttctatgaatatataaactacatcagtgccatgctgtggttagatttatctgatgataacagctaagactatggagagggactttaaaaattctcaaaccattctgtgatcaatctttaacagcaactacatagctcttccttttgcttttgcactgtggcaggaaaaattcttgagctctgagtaatctttatgtgactgataaaaaacatcttaaagctcccatgttaaaatataaaaatggtttgacaatttttgattaccatgactgtcagttatatactatattatgaatatgcagtgtggttcttgttggttgatctgtttaccctgcatagattttaatctgtactttaaaacatctatgataaaaatagtgacagacagaaattaccccaaaaagagacctaggccaggaagggggtgggagctttcataggaatacagcctagaactctccattgtagccacgtatggaatcagccttacttacatgtaggacctttgtgctttaagagctctgggacatattggccaaatagaaaagaagaggacagtatttcaactcagtcatactcaatatttccaattaagatataatcctgacaccattgttcaattaactttgacgccagaagtcaaagccagaactgggaccccacagctcttaagtactggtccctatcctgcctatgcctatagccagccacactggtttccaagttctgtgatcattttgctacaatcatgttagggtgaaaatctgtacgtcagaactgttaaatgctaattatttttaagtgcatgagacctggggccttctctttctacttgcactctgcttatactagtttctatttgtagatctcaggccttcatcataaagacctctatcaactcacaaaagtatttgtctctattagagtggcatgtggtcatttgagtaaaaaaaaaaaaattacatgggtatcggattcataggcatcctgtccatctaagacaagtgttaattttattggcccatcagctggagcccctttcctcttagccataccattgttttctaccaaattaccactcaatatcttaatgaaagcactcaacattaagtgacataaacagtggcatttgggtaagcaacactcagtggggtgctgacatacagtttgggtaagattaaaaaacaccaaaggctgaaatctgtgagtaccaagaactgtgcatataggtttagaaattgactgtgtaccctagaatgtgcagtgtaatattttcaataggtgtttttttaaagaacactagatttttggaataatatatttctaattaggactatactgtttttcaatggtctgttaaaacatcatacagaatatttatttagtttattgtcatgtattggctaactttcaggggcctcagattccatatgtcttcagtggattgatgaatatcaggttaatttgtgcctgccccagccatctctactttattctgaggtattccacaatcctcttgttgcaggtgctgctaaaaaaaactcaaaattgtgtatcaaatattttctttcaactgtaaaaaatcatctgtgttaaagtgaataaaaagtgcattttgaataaccagcacacaa

SEQ ID NO: 25318 - DNA, 5387 bp, Homo sapiens
gcgcactgcttatttcccgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaagtttgccatctcttggagcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatatagtgtttggaattttctgttcatagagctcatcagtaacagtattcagttagcagacagaagtgtagtatgctgtatgaatattttatattaaaatatgaaggtttgagagcaggccattggctactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggatcagtgaaaaacattagtatacgtttttaaataggctaatttttcaacttggatcattaggcttacgtactacttgtttcaaatgtgtcaaatacaaaaatggtaactaggttgacagatactttgtatttttcttttgaattcagacctggaatgtaagtaagtgacaatgcttatggaaagccagttagttagaattggaaatctgtcttgtcattttacaagcattagattcctttcctgtgtgaagaaagcctcagtgaaacaggtctttgccataactttatgaagtgctacagaaagcacaaagaattgattcatgttcatcaatacctgctgagagtactgtcccaggaatatccagtggatggattcatcatccaggaggttcaaaagtaagatggttttcaaatcatttttgagactggttgcataacagcagggtacctgaaagagccttctgggagttagtgaactaggtagattgttttgttcacataacgccaccatcaacttaaagtgaattgtctttgttataaatgaggtcactatggacttaccctaaagatcttctgtacttctctcttccataggacaaatgataagtactacatacctcatctcttgggttattattgtagtcttgcattcatggttatgaatttaaaaataaataccaattatggaaatagtactaaaggcttgccgcacatgaaacattattttaattggtttaaagtccctttataaagagtgctacatggtttagataaaggaaacatataactattgagttacaggggattttattaattataaaatgcaatcaatttaaattacgtaggtttaagactagtcccttggataagccccaagcgaatttgtcttcagattattaaaattagtgctgtaaatcagggtgggcaattcacagcctttctgaactgactgaactagagcttgcagtgaagtgttctgctgagactgagcaccttacagatatttttctccagaagatggtgctgggtaataaaatcatcacaattagggaatggttagtggtctctactgtggcaaatgccaactgttggaattcactttattgtagaaaaacccaaactgagactcttaagttttgtttagcaatgtgtttctggtatgaaacaaactactgtgtcactgtccaggtaggaaacaattctttcaactgggttttcagcataaatgggaactgatgtagaaggcaggatttagcccttctaggcaaaagaaaagctcagttgggtttcacgagtgttcctgtgcttatattcagtctgtgcctacatgttctcatgcatgtctaacctgatttacctcttacctgtaacctaccttatcatgtggcttttaattgacagtcactcagccatttctaagcagatatagtagtacctttcagaactcacattggcaagtgtaaaaagatgacttaaggtgaagtgaggacaaaatcacattctgcatactaacctatttttttctccctttaaggtgctaaacttgcacctcatgtccactcagtaacaagtattgggacgtagagcacagcctcactcagctctgaaaggtaatacagcttgtgaggaagtgagccagcagtggcctttgcaattgtggatcttgagctctgctctcagcagatttcaggtgtaaccatttgttaactgtactgaaggtgtgtcctcaagaagaaagtgttcaaattaaaaaagctgctgccaagt

SEQ ID NO: 25319 - DNA, 2905 bp, Homo sapiens
atttcccgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaagtttgccatctcttggagcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttca

SEQ ID NO: 25320 - DNA, 5288 bp, Homo sapiens
gcgcactgcttatttcccgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaagtttgccatctcttggagcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatatagtgtttggaattttctgttcatagagctcatcagtaacagtattcagttagcagacagaagtgtagtatgctgtatgaatattttatattaaaatatgaaggtttgagagcaggccattggctactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggatcagtgaaaaacattagtatacgtttttaaataggctaatttttcaacttggatcattaggcttacgtactacttgtttcaaatgtgtcaaatacaaaaatggtaactaggttgacagatactttgtatttttcttttgaattcagacctggaatgtaagtaagtgacaatgcttatggaaagccagttagttagaattggaaatctgtcttgtcattttacaagcattagattcctttcctgtgtgaagaaagcctcagtgaaacaggtctttgccataactttatgaagtgctacagaaagcacaaagaattgattcatgttcatcaatacctgctgagagtactgtcccaggaatatccagtggatggattcatcatccaggaggttcaaaagtaagatggttttcaaatcatttttgagactggttgcataacagcagggtacctgaaagagccttctgggagttagtgaactaggtagattgttttgttcacataacgccaccatcaacttaaagtgaattgtctttgttataaatgaggtcactatggacttaccctaaagatcttctgtacttctctcttccataggacaaatgataagtactacatacctcatctcttgggttattattgtagtcttgcattcatggttatgaatttaaaaataaataccaattatggaaatagtactaaaggcttgccgcacatgaaacattattttaattggtttaaagtccctttataaagagtgctacatggtttagataaaggaaacatataactattgagttacaggggattttattaattataaaatgcaatcaatttaaattacgtaggtttaagactagtcccttggataagccccaagcgaatttgtcttcagattattaaaattagtgctgtaaatcagggtgggcaattcacagcctttctgaactgactgaactagagcttgcagtgaagtgttctgctgagactgagcaccttacagatatttttctccagaagatggtgctgggtaataaaatcatcacaattagggaatggttagtggtctctactgtggcaaatgccaactgttggaattcactttattgtagaaaaacccaaactgagactcttaagttttgtttagcaatgtgtttctggtatgaaacaaactactgtgtcactgtccaggtaggaaacaattctttcaactgggttttcagcataaatgggaactgatgtagaaggcaggatttagcccttctaggcaaaagaaaagctcagttgggtttcacgagtgttcctgtgcttatattcagtctgtgcctacatgttctcatgcatgtctaacctgatttacctcttacctgtaacctaccttatcatgtggcttttaattgacagtcactcagccatttctaagcagatatagtagtacctttcagaactcacattggcaagtgtaaaaagatgacttaaggtgaagtgaggacaaaatcacattctgcatactaacctatttttttctccctttaaggtgctaaacttgcacctcatgtccactcagtaacaagtattgggacgtagagcacagcctcactcagctctgaaaggtaatacagcttgtgaggaagtgagccagcagtggcctttgcaattgtggatcttgagctctgctctcagcagatttcaggtgtaaccatttgttaactgtactgaaggtgtgtcctcaagaagaaagtgttcaaattaaaaaagctgctgccaagt

SEQ ID NO: 25321 - DNA, 2875 bp, Homo sapiens
atttcccgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaagtttgccatctcttggagcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttca

SEQ ID NO: 25322 - DNA, 2363 bp, Homo sapiens
ttatttcccgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaaaaaaaaaaa

SEQ ID NO: 25323 - DNA, 3004 bp, Homo sapiens
atttcccgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaagtttgccatctcttggagcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttca

SEQ ID NO: 25324 - DNA, 2171 bp, Homo sapiens
gcgctccgtcaccagggagtgcgggaatccgccgtttgcgctgaggcaatggcggcagctgcgccggtggccgcggacgacgatgagcggcggcggcggccgggggctgcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgc

SEQ ID NO: 25325 - DNA, 2820 bp, Homo sapiens
aacaaaatgggggtggggacgtgcaagtttcagactccgactaactacgcggggactccgaggcgctcagaaaaatgaagccgacccggccctgccccgagggacgctccaagagggcggaggtgcagggagggccccgccacaattcgcggtaacgcaagccaggctcgggcggaagggcggccggagccgatcaaaggctggctccgggcaggggcagcgagggagcgagggggagctctccgcaggccggtgtcccggaggaggcataattggagcagggcttccaaggtcacggagagacgccgggcaagacctcttaaggatcctcttccgggcttgaaaggcaggcgtcctcccgaaccgcgcgacccagccaagaagagccggggcggggccggggccggggccgggggccgactcgggaatcttcggccgaggctcggcaatccccccatcctccgtccggggcctccagcccggggccgatccggaaacagccgagcggatccggaaacagccgagaggacccggaagcggtgcgctccgtcaccagggagtgcgggaatccgccgtttgcgctgaggcaatggcggcagctgcgccggtggccgcggacgacgatgagcggcggcggcggccgggggctgcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgc

SEQ ID NO: 25326 - DNA, 1645 bp, Homo sapiens
ggagtgcgggaatccgccgtttgcgctgaggcaatggcggcagctgcgccggtggccgcggacgacgatgagcggcggcggcggccgggggctgactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggtt

SEQ ID NO: 25327 - DNA, 4679 bp, Homo sapiens
ggcaccgcacacataaatcacgggtgggaggcaggcttggttcccgcttggttccccctgcactgggaagctgccgccccgcttcccttgctcacacagggctttgcagtagtggtggcagccgcggcagaaactggctctggggaagcaattgattcgtctactgccagcagcccggagttgcctacgcggactggaaaggaagggagaagggagagagagagagagagagagagagagagagagagagactcacagagctaaaaccttcatccatgtggaggacagtctgagggagccactgtcccttgtccactgactcactggctggtccgagttttctccgcttctggcagtggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaacgacaacaacaaaaaacccttcctctgtcaccttttctcctcctccctcttctttcccttccatgatagtagattctctctttctcagcctctcccctctcctttctctccctgcctttcttccctttgcctttctctctctctaaagcagtaacaccgcaaaaacaacagcaaaaaaagtgtatgttaacctagcctcacccccttgctctcaccagcctgaccaggaaactgagaaactggcccaaacctgagattccacttgggcccacgcttcttaactgacccactcctcccgttggcagaaccagacattcccagggcttgggccaatggctggcactgccctgagtgcatggcagcatccctcaagctgtgtagatgccccatagaggactctctcatccgtgggctccccgggtgggcacggaggcatttagaagaccagggccatgggtctgaggaagcctcagccaaagcctccagcctttctcctttctccgctcttaggtaaatgaacaagctaccctcctccccaatgcccttgactctgtttcattgactcttttgcatcccatctctcactcagaaccccctccagtctctctgtctctctttgtctgtctctctgtctcctgcactctcgttactaagcttcctgggagaatcaaataatatcatggctatggaacagtagagagagacaggcctgatgccaaaggctttgggctcatcatcaatctttcactttcttcctataaaaaaaattattttataaaggaggaaaaggcaatgtgggcaaacattacaaatttgaggttgaagtcaggcaatcttcaatgccctgtgagaaaggttcgattttcccaattttgatgaagtcttccctcatgaaaatcactcccagtcatcccaaacccctgacattctctacagaagcatcagacagatactcaaactctcactttccccaaatcacatctcttaacttttcaacgccctccaccctcagctccctgcacaattcatgggaggactcatttcttgccttgaataaccattttctaaacatcgagctcttcaccttccccaaggtggccaacagcttcctggctgccatctttccttttgaccttatctttccccattagtccctggtggcacctactctcagcccacctccctcaccacagtttccccttaggagacagcatgctggctgtgtcgcccaagcctgatgctggtgtaggcgctggaatcagcatgcagcaagctcacagtgcccctagtctgggtgcccgctgtccccgacaaatgtaaccacctccctgcctagaatacacacacgtcctccggtgcatgcacaaccacccagcatctttctttgtgatgatgtagccaaaaataaagtaggagcatccaag

SEQ ID NO: 25328 - DNA, 4452 bp, Homo sapiens
tttctttttgtcttggtcctgcatgatttaggggtagttgatgtgtctgtgtgtctacgtgtgtgcactggtgctttgattttattttgggaagagtaggagagtcaaatgaacaattttctttcaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaacgacaacaacaaaaaacccttcctctgtcaccttttctcctcctccctcttctttcccttccatgatagtagattctctctttctcagcctctcccctctcctttctctccctgcctttcttccctttgcctttctctctctctaaagcagtaacaccgcaaaaacaacagcaaaaaaagtgtatgttaacctagcctcacccccttgctctcaccagcctgaccaggaaactgagaaactggcccaaacctgagattccacttgggcccacgcttcttaactgacccactcctcccgttggcagaaccagacattcccagggcttgggccaatggctggcactgccctgagtgcatggcagcatccctcaagctgtgtagatgccccatagaggactctctcatccgtgggctccccgggtgggcacggaggcatttagaagaccagggccatgggtctgaggaagcctcagccaaagcctccagcctttctcctttctccgctcttaggtaaatgaacaagctaccctcctccccaatgcccttgactctgtttcattgactcttttgcatcccatctctcactcagaaccccctccagtctctctgtctctctttgtctgtctctctgtctcctgcactctcgttactaagcttcctgggagaatcaaataatatcatggctatggaacagtagagagagacaggcctgatgccaaaggctttgggctcatcatcaatctttcactttcttcctataaaaaaaattattttataaaggaggaaaaggcaatgtgggcaaacattacaaatttgaggttgaagtcaggcaatcttcaatgccctgtgagaaaggttcgattttcccaattttgatgaagtcttccctcatgaaaatcactcccagtcatcccaaacccctgacattctctacagaagcatcagacagatactcaaactctcactttccccaaatcacatctcttaacttttcaacgccctccaccctcagctccctgcacaattcatgggaggactcatttcttgccttgaataaccattttctaaacatcgagctcttcaccttccccaaggtggccaacagcttcctggctgccatctttccttttgaccttatctttccccattagtccctggtggcacctactctcagcccacctccctcaccacagtttccccttaggagacagcatgctggctgtgtcgcccaagcctgatgctggtgtaggcgctggaatcagcatgcagcaagctcacagtgcccctagtctgggtgcccgctgtccccgacaaatgtaaccacctccctgcctagaatacacacacgtcctccggtgcatgcacaaccacccagcatctttctttgtgatgatgtagccaaaaataaagtaggagcatccaagaaaa

SEQ ID NO: 25329 - DNA, 4179 bp, Homo sapiens
atgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaacgacaacaacaaaaaacccttcctctgtcaccttttctcctcctccctcttctttcccttccatgatagtagattctctctttctcagcctctcccctctcctttctctccctgcctttcttccctttgcctttctctctctctaaagcagtaacaccgcaaaaacaacagcaaaaaaagtgtatgttaacctagcctcacccccttgctctcaccagcctgaccaggaaactgagaaactggcccaaacctgagattccacttgggcccacgcttcttaactgacccactcctcccgttggcagaaccagacattcccagggcttgggccaatggctggcactgccctgagtgcatggcagcatccctcaagctgtgtagatgccccatagaggactctctcatccgtgggctccccgggtgggcacggaggcatttagaagaccagggccatgggtctgaggaagcctcagccaaagcctccagcctttctcctttctccgctcttaggtaaatgaacaagctaccctcctccccaatgcccttgactctgtttcattgactcttttgcatcccatctctcactcagaaccccctccagtctctctgtctctctttgtctgtctctctgtctcctgcactctcgttactaagcttcctgggagaatcaaataatatcatggctatggaacagtagagagagacaggcctgatgccaaaggctttgggctcatcatcaatctttcactttcttcctataaaaaaaattattttataaaggaggaaaaggcaatgtgggcaaacattacaaatttgaggttgaagtcaggcaatcttcaatgccctgtgagaaaggttcgattttcccaattttgatgaagtcttccctcatgaaaatcactcccagtcatcccaaacccctgacattctctacagaagcatcagacagatactcaaactctcactttccccaaatcacatctcttaacttttcaacgccctccaccctcagctccctgcacaattcatgggaggactcatttcttgccttgaataaccattttctaaacatcgagctcttcaccttccccaaggtggccaacagcttcctggctgccatctttccttttgaccttatctttccccattagtccctggtggcacctactctcagcccacctccctcaccacagtttccccttaggagacagcatgctggctgtgtcgcccaagcctgatgctggtgtaggcgctggaatcagcatgcagcaagctcacagtgcccctagtctgggtgcccgctgtccccgacaaatgtaaccacctccctgcctagaatacacacacgtcctccggtgcatgcacaaccacccagcatctttctttgtgatgatgtagccaaaaataaagtaggagcatcc

SEQ ID NO: 25330 - DNA, 4440 bp, Homo sapiens
gctcacacagggctttgcagtagtggtggcagccgcggcagaaactggctctggggaagcaattgattcgtctactgccagcagcccggagttgcctacgcggactggaaaggaagggagaagggagagagagagagagagagagagagagagagagagagactcacagagctaaaaccttcatccatgtggaggacagtctgagggagccactgtcccttgtccactgactcactggctggtccgagttttctccgcttctggcagtggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaagttgaaagatagacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaacgacaacaacaaaaaacccttcctctgtcaccttttctcctcctccctcttctttcccttccatgatagtagattctctctttctcagcctctcccctctcctttctctccctgcctttcttccctttgcctttctctctctctaaagcagtaacaccgcaaaaacaacagcaaaaaaagtgtatgttaacctagcctcacccccttgctctcaccagcctgaccaggaaactgagaaactggcccaaacctgagattccacttgggcccacgcttcttaactgacccactcctcccgttggcagaaccagacattcccagggcttgggccaatggctggcactgccctgagtgcatggcagcatccctcaagctgtgtagatgccccatagaggactctctcatccgtgggctccccgggtgggcacggaggcatttagaagaccagggccatgggtctgaggaagcctcagccaaagcctccagcctttctcctttctccgctcttaggtaaatgaacaagctaccctcctccccaatgcccttgactctgtttcattgactcttttgcatcccatctctcactcagaaccccctccagtctctctgtctctctttgtctgtctctctgtctcctgcactctcgttactaagcttcctgggagaatcaaataatatcatggctatggaacagtagagagagacaggcctgatgccaaaggctttgggctcatcatcaatctttcactttcttcctataaaaaaaattattttataaaggaggaaaaggcaatgtgggcaaacattacaaatttgaggttgaagtcaggcaatcttcaatgccctgtgagaaaggttcgattttcccaattttgatgaagtcttccctcatgaaaatcactcccagtcatcccaaacccctgacattctctacagaagcatcagacagatactcaaactctcactttccccaaatcacatctcttaacttttcaacgccctccaccctcagctccctgcacaattcatgggaggactcatttcttgccttgaataaccattttctaaacatcgagctcttcaccttccccaaggtggccaacagcttcctggctgccatctttccttttgaccttatctttccccattagtccctggtggcacctactctcagcccacctccctcaccacagtttccccttaggagacagcatgctggctgtgtcgcccaagcctgatgctggtgtaggcgctggaatcagcatgcagcaagctcacagtgcccctagtctgggtgcccgctgtccccgacaaatgtaaccacctccctgcctagaatacacacacgtcctccggtgcatgcacaaccacccagcatctttctttgtgatgatgtagccaaaaataaagtaggagcatcc

SEQ ID NO: 25331 - DNA, 2581 bp, Homo sapiens
gttcctaacccttgatcttggcttgttaaccctttctgagcttccctttagcggggggatgaggatggtcggctgtttccacatttaagggcagagctgggtgaagggtggtgttagtgctcgagggtcacgcgcgggtggctttgccgcggtggtggcagcggtggcagaggcgacaccgctggaggcggcggagggacgggcccaccaacgctgcaggccggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgag

SEQ ID NO: 25332 - DNA, 492 bp, Homo sapiens
ggtggctttgccgcggtggtggcagcggtggcagaggcgacaccgctggaggcggcggagggacgggcccaccaacgctgcaggccggttcttgctctgttgcccaggctggactgcagtggcaccagcatggctcactgcagcctcgaccccctaggctcaagtgatcctcctgcttcagcctcctgagtagctgggaccacaggtcatcagttgggtcaaagatggagctactagccaggcctgagacctgagcccctggacaccatgtttctattttctgcttctgtgaaattgcctcttctacatacctcatgcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgtt

SEQ ID NO: 25333 - DNA, 561 bp, Homo sapiens
agaggcgacaccgctggaggcggcggagggacgggcccaccaacgctgcaggccggttcttgctctgttgcccaggctggactgcagtggcaccagcatggctcactgcagcctcgaccccctaggctcaagtgatcctcctgcttcagcctcctgagtagctgggaccacaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgccta

SEQ ID NO: 25334 - DNA, 531 bp, Homo sapiens
gagagggaggaagaggagggagaggggcgatggagaaggtcatcagttgggtcaaagatggagctactagccaggcctgagacctgagcccctggacaccatgtttctattttctgcttctgtgaaattgcctcttctacatacctcatgcaacgttcgttctacataattcagcaccagcttagattctcactatcaaattgaaccctttcccctttgctatccacacaggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggg

SEQ ID NO: 25335 - DNA, 660 bp, Homo sapiens
ttttctgctctgaattctgagaaactccaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaaca

SEQ ID NO: 25336 - DNA, 561 bp, Homo sapiens
acttttcactttcagaatggcgtccagtaaatcaatcctgggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcgga

SEQ ID NO: 25337 - DNA, 570 bp, Homo sapiens
ccttctgaagctggacttgaacctgagaaaatgtgacctggggctgctggcggccagcttgtccccgttaggtgacaataagcagacagaagagccaagcagctatggaggaaaatcaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacag

SEQ ID NO: 25338 - DNA, 534 bp, Homo sapiens
gaatttcaggaatattgggagaagtcaccagaaaagaggactgctcccttctgaagctggacttgaacctgagaaaatgtgacctggggctgctggcggccagcttgtccccgttaggtgacaataagcagacagaagagccaagcagctatggaggaaaatcaggtcatcagttgggtcaaagatggagctactagccaggcctgagacctgagcccctggacaccatgtttctattttctgcttctgtgaaattgcctcttctacatacctcatgcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtca

SEQ ID NO: 25339 - DNA, 538 bp, Homo sapiens
atagttcctttgctctgagagtgagcgacagtattagaaaaagtgtgtggtaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtg

SEQ ID NO: 25340 - DNA, 2961 bp, Homo sapiens
ggacagtctgagggagccactgtcccttgtccactgactcactggctggtccgagttttctccgcttctggcagtggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaa

SEQ ID NO: 25341 - DNA, 579 bp, Homo sapiens
cttcatccatgtggaggacagtctgagggagccactgtcccttgtccactgactcactggctggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtg

SEQ ID NO: 25342 - DNA, 740 bp, Homo sapiens
tttagcggggggatgaggatggtcggctgtttccacatttaagggcagagctgggtgaagggtggtgttagtgctcgagggtcacgcgcgggtggctttgccgcggtggtggcagcggtggcagaggcgacaccgctggaggcggcggagggacgggcccaccaacgctgcaggccggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcag

SEQ ID NO: 25343 - DNA, 557 bp, Homo sapiens
ctttgccgcggtggtggcagcggtggcagaggcgacaccgctggaggcggcggagggacgggcccaccaacgctgcagggtctcgctctgtcacccaggctggagtgcaggagcagatcatagttcaccgcaacctccgcctcctgggctccagtgatccttccatcttagcctcctgagtagctgggaccacagcccctggacaccatgtttctattttctgcttctgtgaaattgcctcttctacatacctcatgagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatgggg

SEQ ID NO: 25344 - DNA, 572 bp, Homo sapiens
aaggcatcttagcgctgtccgtggtgctgaccgccaatcccctggttgccgtttcgaccagctgggatctctggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaag

SEQ ID NO: 25345 - DNA, 562 bp, Homo sapiens
gtctttctacccggcagggaagggaggagttggcaagaatttggctcacccattccccctgcaagcctccagcgtcgcggggcaagaagaggagaagaggaagattgtggtccattcatgttctccagccaatactggccaaggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcct

SEQ ID NO: 25346 - DNA, 2896 bp, Homo sapiens
ccaccactgctgcctgtaagggctgttttggatacagaaaatgtgccctttctaacccaaaaaatgcttgaaatgtgtaaaagtggccagactaacagtcccaaagagggctgccctctaagaggaagcgtcccaaatctgttcagttttagagactacgtgactggggtacgtggtggggccttaccagacatccacgaggagaatccaggccttggtttggctccagctgggcctgcctggtggctgccacttattgacttaagtcccagtgattcagctcctcatctggaacacctcgggtcacccccgacaacggtggtgggagggagagcggcctcctcctccctggtggggcctgtctgggtgaagcccctctgttcccgaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccatgggctggcccaggaccgtgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatctgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaa

SEQ ID NO: 25347 - DNA, 2493 bp, Homo sapiens
acaacggtggtgggagggagagcggcctcctcctccctggtggggcctgtctgggtgaagcccctctgttcccgaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccatgggctggcccaggaccgtgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatctgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagatt

SEQ ID NO: 25348 - DNA, 1204 bp, Homo sapiens
atctggaacacctcgggtcacccccgacaacggtggtgggagggagagcggcctcctcctccctggtggggcctgtctgggtgaagcccctctgttcccgatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctcc

SEQ ID NO: 25349 - DNA, 6019 bp, Homo sapiens
attaaagttggccttatcataaatttcccaatagtatgcctatttcaagtggttctgaaaatgtttgagaatgatgaagatctcttgttatagacagtttttttttcagagcagtattttaagtgcaaagtgtttttttgttgttgttgttgttgggaaaataagaatcttccatattgtagtgtagacagaggacaagtgctcttttgttctcaaacattctattttttcaagtgtattttacccacttatgtgactgagtctgagcctttgctaagggtactgcagctggattatgtagtggaaccaggtccagaaaaagaattgctaaagaatgcaagtaaacaggatgtcagatgttatccttagcctatttccctaaacatagctttttggctgcaaagtaaaatgccattcttctagcttctgcttatacacagtgatggctgacagcaggcataatcttcgtttgcttggcacgttgtcaccatgcaactcaacgtgttttgcaaggaatgatcgtgacacaccatctctgggagatactatgaggacatccggctatttcttggaagaattttctgtctaccttctttgagccctgttgtgccagcacatctccccatgaggctcagatctgtctgacctaagagccagttggcatcgtcctcctaacagaagccagattttcactggggctagactatttattgacagtgttttcccagactggcccatgagtgtctcatttccaaggtcccctgaagtgctggctcacctctgtttcccaaagcacttgcttgcttgtctctcctccctccccagcatccttttcactttcttcccttataacttcttgcactctgtgtgcgtgtgtgtgtatgcgtgtgtgcatgtgcgtttcttctttttttttatcctaacgaatttgttttgcaggttttgaaaaggaaaaaccagcgttatccaggattgttaaattaattcttatctgtttccacatcttggaccgtgatctctgtggttttaaaatcccatattttgagtgggttccgctgttgtttaagaaaagttgctttaaacctttgctctgcaagcacccgaagagaactcataaaaaggaagacaacagcagatgcaatcgcggatgtggcttagtccttgcagctgccccagagtgctgtttggagtgtaccgtcctcagtaatgaatccagaagaacaaatcgtgacatggcttatatctttgggagttttagagtcccctaaaaagaccatctgtgatccggaggagtttttaaagtcctcgctgaaaaatggggtagttctgtgcaaactgatcaacagactcatgcctggctctgtggaaaagttttgtctggatccccaaactgaagctgactgcatcaacaacatcaatgacttcctgaaaggatgtgcaaccctccaagtggaaatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaataa

SEQ ID NO: 25350 - DNA, 4764 bp, Homo sapiens
agtttcgccctggtggcggccgcgctcagggcagggtcccagctccggctgggttgatctgttcccgcagccttggcacaggcttgcccgcccgctcgccggccccgtgactcgggagggcgaacggcttccaggaggcggcggcggcgcggctggagtgagggagcagctggaggacaggcgggcagcggccgagccagatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaataa

SEQ ID NO: 25351 - DNA, 4779 bp, Homo sapiens
gccctgaccctgccacttgtgtgaagtcaggatctcctttcccaggcctcagttgagtcatctgtaaaatgaggagactagagtaggggttgggtaatgtctaatggttgtaatgtctgtttttaacttgcccatttccatcagtttccgctaggcaaagctttgcatatttagctgctcagttggaactagtaggaagaccaaagaggattttgatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaataa

SEQ ID NO: 25352 - DNA, 2654 bp, Homo sapiens
aaagttgcagccgcccctccccgctggggcgagcctagcccagctctccagtttcgccctggtggcggccgcgctcagggcagggtcccagctccggctgggttgatctgttcccgcagccttggcacaggcttgcccgcccgctcgccggccccgtgactcgggagggcgaacggcttccaggaggcggcggcggcgcggctggagtgagggagcagctggaggacaggcgggcagcggccgagccagatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgatggagtttcgctcttgttgcccgggctggagtgcaatggcgcgatctcagctcaccacaacctctgcctcccaggttcaaagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtg

SEQ ID NO: 25353 - DNA, 5265 bp, Homo sapiens
ctcatttccaaggtcccctgaagtgctggctcacctctgtttcccaaagcacttgcttgcttgtctctcctccctccccagcatccttttcactttcttcccttataacttcttgcactctgtgtgcgtgtgtgtgtatgcgtgtgtgcatgtgcgtttcttctttttttttatcctaacgaatttgttttgcaggttttgaaaaggaaaaaccagcgttatccaggattgttaaattaattcttatctgtttccacatcttggaccgtgatctctgtggttttaaaatcccatattttgagtgggttccgctgttgtttaagaaaagttgctttaaacctttgctctgcaagcacccgaagagaactcataaaaaggaagacaacagcagatgcaatcgcggatgtggcttagtccttgcagctgccccagagtgctgtttggagtgtaccgtcctcagtaatgaatccagaagaacaaatcgtgacatggcttatatctttgggagttttagagtcccctaaaaagaccatctgtgatccggaggagtttttaaagtcctcgctgaaaaatggggtagttctgtgcaaactgatcaacagactcatgcctggctctgtggaaaagttttgtctggatccccaaactgaagctgactgcatcaacaacatcaatgacttcctgaaaggatgtgcaaccctccaagtggaaatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagaggcttttacttttgtttttgaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgcttt

SEQ ID NO: 25354 - DNA, 3749 bp, Homo sapiens
aggcgcacaggtaccattttgaccgtaaacatcctgccgatttgaaccgaggatttgggcggcaggaagagccgcggcgtaacggcagccatcttgtttgtttgagtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttacattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgt

SEQ ID NO: 25355 - DNA, 2163 bp, Homo sapiens
gaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaagactccctgaaggtacttttagtattccagctagtgcagtgccttgtacaaagatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccagcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctccgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaatttagaattgtgattaaagtgagcatttgtcta

SEQ ID NO: 25356 - DNA, 2119 bp, Homo sapiens
acagcgcgtgcgccgccgcaagcatggctggtgatgattggacgactggtaacagggggcggagggctccgaagtctggttttgggcgggaattgaaaccgccgctgaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaagactccctgaaggtacttttagtattccagctagtgcagtgccttgtacaaagatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctccgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaatttagaattgtgattaaagtgagcatttgtcta

SEQ ID NO: 25357 - DNA, 2113 bp, Homo sapiens
gaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccagcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctccgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaatttagaattgtgattaaagtgagcatttgtctat

SEQ ID NO: 25358 - DNA, 1036 bp, Homo sapiens
cgccgctgaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggtgagaggcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccaggtatggcatatttatcatcaaggacaggagcttggaaaattatcactgcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggtt

SEQ ID NO: 25359 - DNA, 565 bp, Homo sapiens
agcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttac

SEQ ID NO: 25360 - DNA, 1158 bp, Homo sapiens
tagccgcgcaggtgcggtgaagggaggatggcggagttggtaccttttgcggttcccatcgagagtgacaaaaccttgctagtgtgggagctgagctccggacccacggccgaggctttgcatcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaaggaccattatcattccttatgaaaaggaagacagcccagaagcttgctattcagaaggctttgtcagatgcattccagaaactgttgattgttgttctagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactagcatttctgaatatcccaaggcgaggtcatgtaacttccttgggaagctctgtcgtgcccctaccccacgccgccccaccactataggctgctggagtcctggaaccacctgggtcggccgcccaaatctttcctggcgaaggggagggaaggggtgttctggtggagtgggaagggaggcttgggtaggattgtgggataagatcgccctggtgacgaggagcggatctcgaacggaacttaataaaggttgcctagataaagatatggtaaataa

SEQ ID NO: 25361 - DNA, 542 bp, Homo sapiens
tctgggcgtgagatttcatgcatttacttgtcccacccccacagcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaaggaccattatcattccttatgaaaaggaagacagcccagaagcttgctattcagaaggctttgtcagatgcattccagaaactgttgattgttgttctaggtaagactgtcttgatcatccttgaagtacttcagtttcagtaagcaaataaactcattttgaaaagttaattgaataaaaatattgatatctaaa

SEQ ID NO: 25362 - DNA, 779 bp, Homo sapiens
cggtgaagggaggatggcggagttggtaccttttgcggttcccatcgagagtgacaaaaccttgctagtgtgggagctgagctccggacccacggccgaggctttgcatcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaaggaccattatcattccttatgaaaaggaagacagcccagaagcttgctattcagaaggctttgtcagatgcattccagaaactgttgattgttgttctaggtaagactgtcttgatcatccttgaagtacttcagtttcagtaagcaaataaactcattttgaaaagttaattgaataaaaatattgatatctaaagca

SEQ ID NO: 25363 - DNA, 1535 bp, Homo sapiens
tgctggggcgagggttagccgcgcaggtgcggtgaagggaggatggcggagttggtaccttttgcggttcccatcgagagtgacaaaaccttgctagtgtgggagctgagctccggacccacggccgaggctttgcatgtgagccggggccaggatggagggagggatggagaaagctgcccacccgctgactgggagttccggagtcctgcctcagaccctcacctgcctgagcctccgctgaaggactcttaattataaaggggatcccaactgacaactgacgacccccaacagatttttagagtcccggagaggtatctctccaccttcagaacgttttaccttccagtgcttcttaaagtttaggattttaagaggaaaacctgttgattaagtgggaagtgttttgaatcgcatccttcgcgaagagaggtttggggaatatgagggcatgtgcggttttgttttctgggcgtgagatttcatgcatttacttgtcccacccccacagcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaaggaccattatcattccttatgaaaaggaagacagcccagaagcttgctattcagaaggctttgtcagatgcattccagaaactgttgattgttgttctagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactagcatttctgaatatcccaaggcgaggtcatgtaacttccttgggaagctctgtcgtgcccctaccccacgccgccccaccactataggctgctggagtcctggaaccacctgggtcggccgcccaaatctttcctggcgaaggggagggaaggggtgttctggtggagtgggaagggaggcttgggtaggattgtgggataagatcgccctggtgacgaggagcggatctcgaacggaacttaataaaggttgcctagataaa

SEQ ID NO: 25364 - DNA, 669 bp, Homo sapiens
tttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactagcatttctgaatatcccaaggcgaggtcatgtaacttccttgggaagctctgtcgtgcccctaccccacgccgccccaccactataggctgctggagtcctggaaccacctgggtcggccgcccaaatctttcctggcgaaggggagggaaggggtgttctggtggagtgggaagggaggcttgggtaggattgtgggataagatcgccctggtgacgaggagcggatctcgaacggaacttaataaaggttgcctagataaagatatggtaaataa

SEQ ID NO: 25365 - DNA, 812 bp, Homo sapiens
ggcgcaatgctggggcgagggttagccgcgcaggtgcggtgaagggaggatggcggagttggtaccttttgcggttcccatcgagagtgacaaaaccttgctagtgtgggagctgagctccggacccacggccgaggctttgcatcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaaggtcccttgctctccctggaagcagtatggccaagaggaggaagggtatctctcggatttcagcttggaggaggaagagttcaggctgccagaacttgactagcatttctgaatatcccaaggcgaggtcatgtaacttccttgggaagctctgtcgtgcccctaccccacgccgccccaccactataggctgctggagtcctggaaccacctgggtcggccgcccaaatctttcctggcgaaggggagggaaggggtgttctggtggagtgggaagggaggcttgggtaggattgtgggataagatcgccctggtgacgaggagcggatctcgaacggaacttaataaaggttgcctagataaa

SEQ ID NO: 25366 - DNA, 1491 bp, Homo sapiens
agccgcgcaggtgcggtgaagggaggatggcggagttggtaccttttgcggttcccatcgagagtgacaaaaccttgctagtgtgggagctgagctccggacccacggccgaggctttgcatgtgagccggggccaggatggagggagggatggagaaagctgcccacccgctgactgggagttccggagtcctgcctcagaccctcacctgcctgagcctccgctgaaggactcttaattataaaggggatcccaactgacaactgacgacccccaacagatttttagagtcccggagaggtatctctccaccttcagaacgttttaccttccagtgcttcttaaagtttaggattttaagaggaaaacctgttgattaagtgggaagtgttttgaatcgcatccttcgcgaagagaggtttggggaatatgagggcatgtgcggttttgttttctgggcgtgagatttcatgcatttacttgtcccacccccacagcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaaggaccattatcattccttatgaaaaggaagacagcccagaagcttgctattcagaaggctttgtcagatgcattccagaaactgttgattgttgttctaggtaagactgtcttgatcatccttgaagtacttcagtttcagtaagcaaataaactcattttgaaaagttaattgaataaaaatattgatatctaaagcactctatagtatgctttcatttgctaaattatttcacaccaacaggctcaaatttgttctgtgtgacatttgtgaaaaaaaatgacagcaaatattgtccccagtttacagatgtgaaaagacttgcctcagttcccacagaaaatgtttaagccaggtcttctttaattgcttacctatcatacagaatagtgattataagttttggacgcatggatttgagtcctaactctgtctcttagatttttaatgcaattaggccgggcgcggtggctcacgcctgtaatcccagcactttgggaggccgagatgggcggatcacga

SEQ ID NO: 25367 - DNA, 1067 bp, Homo sapiens
ggcgcaatgctggggcgagggttagccgcgcaggtgcggtgaagggaggatggcggagttggtaccttttgcggttcccatcgagagtgacaaaaccttgctagtgtgggagctgagctccggacccacggccgaggctttgcatcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactagcatttctgaatatcccaaggcgaggtcatgtaacttccttgggaagctctgtcgtgcccctaccccacgccgccccaccactataggctgctggagtcctggaaccacctgggtcggccgcccaaatctttcctggcgaaggggagggaaggggtgttctggtggagtgggaagggaggcttgggtaggattgtgggataagatcgccctggtgacgaggagcggatctcgaacggaacttaataaaggttgcctagataaa

SEQ ID NO: 25368 - DNA, 997 bp, Homo sapiens
ggcgcaatgctggggcgagggttagccgcgcaggtgcggtgaagggaggatggcggagttggtaccttttgcggttcccatcgagagtgacaaaaccttgctagtgtgggagctgagctccggacccacggccgaggctttgcatcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaaggaccattatcattccttatgaaaaggaagacagcccagaagcttgctattcagaaggctttgtcagatgcattccagaaactgttgattgttgttctagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactagcatttctgaatatcccaaggcgaggtcatgtaacttccttgggaagctctgtcgtgcccctaccccacgccgccccaccactataggctgctggagtcctggaaccacctgggtcggccgcccaaatctttcctggcgaaggggagggaaggggtgttctggtggagtgggaagggaggcttgggtaggattgtgggataagatcgccctggtgacgaggagcggatctcgaacggaacttaataaaggttgcctagataaa

SEQ ID NO: 25369 - DNA, 432 bp, Homo sapiens
atgcatttacttgtcccacccccacagcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaaggtcccttgctctccctggaagcagtatggccaagaggaggaagggtatctctcggatttcagcttggaggaggaagagttcaggctgccagaacttgactag

SEQ ID NO: 25370 - DNA, 3068 bp, Homo sapiens
gattggcttcgccgaggcgggatccttgagcttctccggcggcgaggggatagctggttaccagaaggacttctttgcagggccagtggtttctgtcagattttcgccggtcacgactgctgaatatgagacgatctgcagcaccaagtcagttgcaggggaattccttcaaaaaaccaaaatttatacctccaggaagaagtaatccaggtctgaatgaagagattacaaaactgaatccagatataaaattatttgagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacagttcattcggctcctaaagaagtagcagtgtccaaggaacaagaagagaaatctgatagcctagttaaatatttcagtgttgtttggtgtaagccttcaaagaaaaaacataaaaagtgggaaggtgatgctgttcttattgtaaaaggaaagtcatttatattaaagaatttggaaggcaaagacattggaagaggcattggttataaattcaaagagcttgaaaagattgaagagggccaaacactgatgatttgtggaaaagaaatagaagtcatgggtgtaatctctccagatgacttcagcagtggcaggtgttttcagcttggaggaggaagtactgctatctcgcattcttctcaggttgccaggaaatgtttctctaaccctttcaaaagtgtttgtaaaccaagttcaaaggaaaatagacagaatgatttccaaaattgcaaaccacgccatgacccatatacgccaaattccctcgttatgccacgaccagataagaatcaccagtgggtattcaataagaactgtttccctcttgtggatgtagtgattgatccttaccttgtatatcatcttcgaccacatcagaaagaaggaatcatattcctttatgaatgtgtaatgggaatgagaatgaatggcagatgtggagctattcttgctgatgaaatgggtttagggaagacattgcaatgtatttcgctcatctggaccctgcagtgtcagggaccctatggaggcaagccagtaataaagaagacactaattgtcacacctggaagcttggtgaataattggaagaaagaatttcaaaaatggctaggaagtgaaaggatcaagatatttactgttgatcaggaccacaaagttgaagaattcatcaagtctatattttattctgttcttattatcagttatgaaatgttacttcgttccctggatcaaattaagaatataaaatttgatcttctaatctgtgacgaggggcatcgtttgaagaacagtgccattaagacaactacagccctcattagcctttcttgtgagaaaagaataattctaactggtactccaattcagaatgatctgcaagaattttttgcattaattgattttgtaaatccaggaatattaggctctttgtcatcttataggaaaatatatgaagaacccatcattttatcgagagaaccttctgcttctgaggaagaaaaggagttaggagaaagaagagcagctgaacttacttgcctcactggactctttatccttagaagaacccaagaaattataaataaatatctcccacctaaaatagagaatgttgtcttttgccgaccaggagcactacagattgagctttatcgaaagctgttaaattctcaggttgtcaggttctgccttcaagggttgttggaaaatagtccccatctaatatgtataggagctcttaaaaaactgtgcaatcacccctgccttttgttcaactctataaaggaaaaggaatgtagctcaacttgtgataaaaatgaagaaaagagtctatacaaaggcttgctaagtgtgtttcctgctgactacaaccctctcctgtttactgaaaaggagtcaggaaaactacaggtgttgtccaagctcttagcggttatccacgaacttcgacctactgaaaaggtggtgttggtatccaactatacacaaaccttgaacattttacaagaagtatgtaagcgtcatggatatgcttatacaagacttgatggacaaacaccaatctctcaaaggcagcagattgttgatggctttaacagtcaacactcttctttttttatttttttgttaagttcaaaagctggtggtgtaggacttaacctcattggaggatctcacttaattctctatgacattgattggaatccagccactgacattcaggcaatgtctagagtatggagagatggtcagaaatatcctgtacatatttacagactcctaactacaggtacaatagaagaaaagatctatcaaaggcagatcagtaagcaaggtctttgtggggcagttgtcgacctcaccaagacatctgaacatattcagttttcagtagaagaacttaaaaatttgttcacattacatgaaagttcagattgtgttactcatgatctgcttgactgtgagtgtacaggagaagaagttcatacaggtgattcgttggaaaaattcattgtctctagagattgtcagcttggtccacatcaccagaaatctaactccctgaaacctctttctatgtcccagctgaagcaatggaaacatttttctggagatcatttaaatcttacagatccttttcttgaaagaataacagaaaatgtgtcattcatttttcagaatataaccactcaagctactggcacatagtgaaagattacttctgacattccattgctcttcttttgaaaattagtatggtaattaaatgtactttttgaaaattaatagaattatttaaattacagtatatgttgcaaaatatatcacttttgatacaatagtcaaaattgagtggtttaatgttttgtaaatattaagtgtttaaatgaaaaataaagatgtgcttatatcattgta

SEQ ID NO: 25371 - DNA, 1158 bp, Homo sapiens
ttgtgaaaagagctgagcagagctgaaggctgcatggtggtttcagaaactgcctacttaatttgaaaagaacaatggtaggaaaggctagatcttccaattttaccttatccgaaaagcttgatttgctaaagcttgtgaagccatatgtgaaaattctcgaagaacacactaataaacattcagtaatagtagaaaagaatagatgttgggatatcatagcagttaactataatgcaattggagtagaccgccctcctcgaacagcacagggcctacgcaccctttataaaaggctcaaagaatatgccaaacaggagctattgcagcaaaaagagacccaatcagattttaaaagcaatatttctgagccaaccaagaaagttatggagatgattccccagatttccagtttttgcctggtaagagacaggaaccacatacaaagtgcaaacttggatgaggaggcacaggctggtaccagttcactacaggtaatgttggatcaccatcctgttgctattacagtggaggtgaagcaagaagaagacattaaaccacctcctccactggttttaaattctcaacagagtgatactttagagcaaagagaagaacatgaattagtacatgttatggaaagatccttgtcgccttcactttcctctgttgatatgagaatgacatcgtctccatcttctattccaaggagagatgatttttttcggcatgagagtggtgaacactttaggtcactattagggtatgatcctcagatcctgcaaatgttgaaagaggagcatcagataattttagaaaatcaaaaaaattttggattgtatgttcaggagaagagggatggattgaaaagaaggcagcagctagaggaagagctactaagagcaaaaattgaagtggagaagctgaaagcaattcgcttacggcatgatctacctgaatataacagtctctaagtttttttttcaatcttgcaatttgataattttgattttggccaaattactttaatttgggaatatcctgaaacagaatacacgttcttgaaaaatgttgttaatctctattatggaaaaactttttagatataattttctaattattttcttttgagatattaaaatttactggttggttggc

SEQ ID NO: 25372 - DNA, 472 bp, Homo sapiens
tcctccaggcctctgaagaagaaattcagaacaaagaataatagcagttagagttcagtcctgtttcccctaatctgaggtcacgactgctgaatatgagacgatctgcagcaccaagtcagttgcaggggaattccttcaaaaaaccaaaatttatacctccaggaagaagtaatccaggtctgaatgaagagattacaaaactgaatccagatataaaattatttgagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacagttcattcggctcctaaagaagtagcagtgtccaaggaacaagaagagaaatctgatagcctagttaaatattt

SEQ ID NO: 25373 - DNA, 1879 bp, Homo sapiens
ggatagctggttaccagaaggacttctttgcagggccagtggtttctgtcagattttcgccggtcacgactgctgaatatgagacgatctgcagcaccaagtcagttgcaggggaattccttcaaaaaaccaaaatttatacctccaggaagaagtaatccaggtctgaatgaagagattacaaaactgaatccagatataaaattatttgagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacagtgcaaacttggatgaggaggcacaggctggtaccagttcactacaggtaatgttggatcaccatcctgttgctattacagtggaggtgaagcaagaagaagacattaaaccacctcctccactggttttaaattctcaacagagtgatactttagagcaaagagaagaacatgaattagtacatgttatggaaagatccttgtcgccttcactttcctctgttgatatgagaatgacatcgtctccatcttctattccaaggagagatgatttttttcggcatgagagtggtgaacactttaggtcactattagggtatgatcctcagatcctgcaaatgttgaaagaggagcatcagataattttagaaaatcaaaaaaattttggattgtatgttcaggagaagagggatggattgaaaagaaggcagcagctagaggaagagctactaagagcaaaaattgaagtggagaagctgaaagcaattcgcttacggcatgatctacctgaatataacagtctctaagtttttttttcaatcttgcaatttgataattttgattttggccaaattactttaatttgggaatatcctgaaacagaatacacgttcttgaaaaatgttgttaatctctattatggaaaaactttttagatataattttctaattattttcttttgagatattaaaatttactggttggttggcatggttatagtttttattgtcttcttttttttttccctaagtttaattgttgaccttacaaaagatattttattctgatcactaagatatacacaaatgcatatacaaacacatattctttcaaagttctgagtcttcaacatttttagttagaactttgaaagctataattagagatttttaagtcagtctaatttaggagctatactaacctaataccaagaagcttgtctgtatgacattggtttttatgcttttatcttttgaaggagtaaatcctaggattttagagatggaagatatttggagaacactttttttccatctctgcagtttaggggtaatgaaacaggtccagggagaactcaatgacttacttagggtaacaaagctatttatggcagagcagagaccagcacttagtttttctttgtgtaatttccatcccgctattcgatagaagtaaatatccactaaaacattctctagatttaaatattagaagcatttctttcattaaaattgcctttaaagattgttaggttgtgaaatcaggataattacatcaattacccccattctctctctatttttgttccagcaaaatagataaggtattccattgaagctattatatattttggctgtgtgatttaaagacatgtcttaattcattttgaatgtcctgttctggaaaaaatttctttcacagtaaaaatcagaatgaacaaaattaaaattttatgtattttataagtattgttattttagtattcatggaaataaa

SEQ ID NO: 25374 - DNA, 1879 bp, Homo sapiens; identical to SEQ ID NO: 25373

SEQ ID NO: 25375 - DNA, 3040 bp, Homo sapiens
cttgagcttctccggcggcgaggggatagctggttaccagaaggacttctttgcagggccagtggtttctgtcagattttcgccggtcacgactgctgaatatgagacgatctgcagcaccaagtcagttgcaggggaattccttcaaaaaaccaaaatttatacctccaggaagaagtaatccaggtctgaatgaagagattacaaaactgaatccagatataaaattatttgagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacagttcattcggctcctaaagaagtagcagtgtccaaggaacaagaagagaaatctgatagcctagttaaatatttcagtgttgtttggtgtaagccttcaaagaaaaaacataaaaagtgggaaggtgatgctgttcttattgtaaaaggaaagtcatttatattaaagaatttggaaggcaaagacattggaagaggcattggttataaattcaaagagcttgaaaagattgaagagggccaaacactgatgatttgtggaaaagaaatagaagtcatgggtgtaatctctccagatgacttcagcagtggcaggtgttttcagcttggaggaggaagtactgctatctcgcattcttctcaggttgccaggaaatgtttctctaaccctttcaaaagtgtttgtaaaccaagttcaaaggaaaatagacagaatgatttccaaaattgcaaaccacgccatgacccatatacgccaaattccctcgttatgccacgaccagataagaatcaccagtgggtattcaataagaactgtttccctcttgtggatgtagtgattgatccttaccttgtatatcatcttcgaccacatcagaaagaaggaatcatattcctttatgaatgtgtaatgggaatgagaatgaatggcagatgtggagctattcttgctgatgaaatgggtttagggaagacattgcaatgtatttcgctcatctggaccctgcagtgtcagggaccctatggaggcaagccagtaataaagaagacactaattgtcacacctggaagcttggtgaataattggaagaaagaatttcaaaaatggctaggaagtgaaaggatcaagatatttactgttgatcaggaccacaaagttgaagaattcatcaagtctatattttattctgttcttattatcagttatgaaatgttacttcgttccctggatcaaattaagaatataaaatttgatcttctaatctgtgacgaggggcatcgtttgaagaacagtgccattaagacaactacagccctcattagcctttcttgtgagaaaagaataattctaactggtactccaattcagaatgatctgcaagaattttttgcattaattgattttgtaaatccaggaatattaggctctttgtcatcttataggaaaatatatgaagaacccatcattttatcgagagaaccttctgcttctgaggaagaaaaggagttaggagaaagagagcagctgaacttacttgcctcactggactctttacttagaagaacccaagaaattataaataaatatctcccacctaaaatagagaatgttgtcttttgccgaccaggagcactacagattgagctttatcgaaagctgttaaattctcaggttgtcaggttctgccttcaagggttgttggaaaatagtccccatctaatatgtataggagctcttaaaaaactgtgcaatcacccctgccttttgttcaactctataaaggaaaaggaatgtagctcaacttgtgataaaaatgaagaaaagagtctatacaaaggcttgctaagtgtgtttcctgctgactacaaccctctcctgtttactgaaaaggagtcaggaaaactacaggtgttgtccaagctcttagcggttatccacgaacttcgacctactgaaaaggtggtgttggtatccaactatacacaaaccttgaacattttacaagaagtatgtaagcgtcatggatatgcttatacaagacttgatggacaaacaccaatctctcaaaggcagcagattgttgatggctttaacagtcaacactcttctttttttatttttttgttaagttcaaaagctggtggtgtaggacttaacctcattggaggatctcacttaattctctatgacattgattggaatccagccactgacattcaggcaatgtctagagtatggagagatggtcagaaatatcctgtacatatttacagactcctaactacaggtacaatagaagaaaagatctatcaaaggcagatcagtaagcaaggtctttgtggggcagttgtcgacctcaccaagacatctgaacatattcagttttcagtagaagaacttaaaaatttgttcacattacatgaaagttcagattgtgttactcatgatctgcttgactgtgagtgtacaggagaagaagttcatacaggtgattcgttggaaaaattcattgtctctagagattgtcagcttggtccacatcaccagaaatctaactccctgaaacctctttctatgtcccagctgaagcaatggaaacatttttctggagatcatttaaatcttacagatccttttcttgaaagaataacagaaaatgtgtcattcatttttcagaatataaccactcaagctactggcacatagtgaaagattacttctgacattccattgctcttcttttgaaaattagtatggtaattaaatgtactttttgaaaattaatagaattatttaaattacagtatatgttgcaaaatatatcacttttgatacaatagtcaaaattgagtggtttaatgttttgtaaatattaagtgtttaaatgaaaaataaagatgtgcttatatcattgt

SEQ ID NO: 25376 - DNA, 1846 bp, Homo sapiens
gcagagacgagatcgcgaagctttgaaaagcgcgggcaacatccgggcacctgggccgtcgagctgaggcgcgccttccgagcctgctttttagggcggatggcagccatgctgaagtgcgtgatgagcggcagtcaggtgaaagtatttgggaaagcagttcaagctctatcacgaattagtgacgagttctggctagacccatctaaaaaaggtcttgctctaagatgtgtgaattcttctcggtcagcatatggatgtgtcctgttctctcctgtgttttttcagcattatcaatggtcagctttagtgaaaatgagtgaaaatgaacttgacacaacactgcatttaaaatgcaaattgggaatgaagtcaattttgcccatctttagatgtctgaattcccttgaaagaaatatagagaagtgcagaatattcaccagatctgataaatgcaaagtagttattcaattcttctacagacatggtattaaaagaactcataatatatgttttcaagaaagtcagcctttgcaagttatttttgacaagaatgtttgtactaatacgctaatgattcaaccaagattgcttgctgatgccattgttctttttacatcaagtcaagaggaagttactcttgctgttactccactgaatttttgcctcaagagttctaatgaggaatcaatggatttgagcaatgctgtacacagtgagatgtttgttggctcagatgagtttgacttctttcaaattggaatggacactgagataacattttgtttcaaagaattgaagggaatactgacattttcagaagctacacatgctcctatatccatttattttgatttccctgggaaacctctggctttgagtattgatgatatgttagtggaagctaactttattttggccacattagctgatgaacaaagtagagcatcttcaccacagtcactgtgtctttcacagaaacgaaaaaggtcagatctgattgaaaaaaaggctggcaaaaatgtaactggccaggccctggaatgtatttcaaaaaaagcagcaccaagaaggctttatcctaaggagactctcacaaacatatctgcattggaaaactgtggcagccctgcaatgaaaagagtggatggagatgtcagtgaagtatcagaaagcagtgtcagcaacacagaggaagtgccagggtctctgtgtctcagaaagttttcttgcatgttctttggagcagtttcttctgaccagcaagaacacttcaaccaccctttcgacagtctggcaagagcaagtgacagtgaagaggacatgaataatgtgtgctgcaggaaagaatttaatggaagtgatgccaaatatttctgtattatctgacatagaacagtatcctccactgccaagacagcctgagtttggagtggaataaggtggaagacaaatgtctctgttctttggccctttaagagttagctttttacctgcacaaatggactaaaaaatctggcacaaaacattgttatgtaatgtcttatgatgtgtgcctctccctcccccaaacctgtttacagtcaattataacctgacaaacgagacttttgtaacatattattgttacatctttctgaaaccttcaaaccgtaaggaagtgttaactggcaagcagttgtactttagactttgtgagaaattcataaaggtggctgagtggatttgcatgctttagaactgtgaatagagttctaactgaaaccagaattaatttggctcttgtagcttagtaatgagtcatagctacccacaataacctaataaaaactcaagttcatcccaa

SEQ ID NO: 25377 - DNA, 2794 bp, Homo sapiens
aaagccgtttgggaacttgtggaggcggggtggtagagtgcagagacgagatcgcgaagctttgaaaagcgcgggcaacatccgggcacctgggccgtcgagctgaggcgcgccttccgagcctgctttttagggcggatggcagccatgctgaatatttgggaaagcagttcaagctctatcacgaattagtgacgagttctggctagacccatctaaaaaaggtcttgctctaagatgtgtgaattcttctcggtcagcatatggatgtgtcctgttctctcctgtgttttttcagcattatcaatggtcagctttagtgaaaatgagtgaaaatgaacttgacacaacactgcatttaaaatgcaaattgggaatgaagtcaattttgcccatctttagatgtctgaattcccttgaaagaaatatagagaagtgcagaatattcaccagatctgataaatgcaaagtagttattcaattcttctacagacatggtattaaaagaactcataatatatgttttcaagaaagtcagcctttgcaagttatttttgacaagaatgtttgtactaatacgctaatgattcaaccaagattgcttgctgatgccattgttctttttacatcaagtcaagaggaagttactcttgctgttactccactgaatttttgcctcaagagttctaatgaggaatcaatggatttgagcaatgctgtacacagtgagatgtttgttggctcagatgagtttgacttctttcaaattggaatggacactgagataacattttgtttcaaagaattgaagggaatactgacattttcagaagctacacatgctcctatatccatttattttgatttccctgggaaacctctggctttgagtattgatgatatgttagtggaagctaactttattttggccacattagctgatgaacaaagtagagcatcttcaccacagtcactgtgtctttcacagaaacgaaaaaggtcagatctgattgaaaaaaaggctggcaaaaatgtaactggccaggccctggaatgtatttcaaaaaaagcagcaccaagaaggctttatcctaaggagactctcacaaacatatctgcattggaaaactgtggcagccctgcaatgaaaagagtggatggagatgtcagtgaagtatcagaaagcagtgtcagcaacacagaggaagtgccagggtctctgtgtctcagaaagttttcttgcatgttctttggagcagtttcttctgaccagcaagaacacttcaaccaccctttcgacagtctggcaagagcaagtgacagtgaagaggacatgaataatggcagtttctctatattctaatgcttaatgatggctgagctgggccccagcccagtgactggctcatttgcccctcaagcacgagtttgcatgtttagtgtctaaaagaggttgtccaggacttccttttaatggaggatgggcttttaaaccacatcatcttgtacaacaaccatatctagaaatagctgtttgtcaagtgtatgtaacttgctttaaatccattatgctacttgtgaggcagaagagttttctgtgaaggaaaaaagcccattagagttcttcaattcaatgcacgttcaccctagagcttttaacatctttgctagttttataaaggtatttaaactttattcaacagccatttagagtgccatcaagatggcttgaaatggaattttgtgatttgtagtcaggtatcttttgtatttgattgcaaacatttggattttagttttctcatgtaataccatggccttttttgtgcattgttttttatattttaagactttaagtagaataaaccctggaaaaaagatcaagagtaaaaatatatagtcactttcacttggcttttttagacggagtctcactttgtcactcaggctcaagtgcagtggtgcaatctctgctcactgcaacatctgcctcccaggtccaagcgattctcctgcctcagcctcccgtgcagctgggattgcaggtgcgtgccaccatgcctggctaatttctggtattttgtagagacagggtttcgccatgttggccagggtggtcttgaactcctggcctcaagtgatctgcccacctcggcctcccaaagtgctgggattacagacttgagccactgcgcccaacctggagtgtttttacatattgtaaaattttatttcctaacctcaaattgttctgattttcagatgtgattttttattttgcagtgtgctgcaggaaagaatttaatggaagtgatgccaaatatttctgtattatctgacatagaacagtatcctccactgccaagacagcctgagtttggagtggaataaggtggaagacaaatgtctctgttctttggccctttaagagttagctttttacctgcacaaatggactaaaaaatctggcacaaaacattgttatgtaatgtcttatgatgtgtgcctctccctcccccaaacctgtttacagtcaattataacctgacaaacgagacttttgtaacatattattgttacatctttctgaaaccttcaaaccgtaaggaagtgttaactggcaagcagttgtactttagactttgtgagaaattcataaaggtggctgagtggatttgcatgctttagaactgtgaatagagttctaactgaaaccagaattaatttggctcttgtagcttagtaatgagtcatagctacccacaataacctaataaaaactcaagttcatccc

SEQ ID NO: 25378 - DNA, 2727 bp, Homo sapiens
gggccgtcgagctgaggcgcgccttccgagcctgctttttagggcggatggcagccatgctgaagtgcgtgatgagcggcagtcagtatttgggaaagcagttcaagctctatcacgaattagtgacgagttctggctagacccatctaaaaaaggtcttgctctaagatgtgtgaattcttctcggtcagcatatggatgtgtcctgttctctcctgtgttttttcagcattatcaatggtcagctttagtgaaaatgagtgaaaatgaacttgacacaacactgcatttaaaatgcaaattgggaatgaagtcaattttgcccatctttagatgtctgaattcccttgaaagaaatatagagaagtgcagaatattcaccagatctgataaatgcaaagtagttattcaattcttctacagacatggtattaaaagaactcataatatatgttttcaagaaagtcagcctttgcaagttatttttgacaagaatgtttgtactaatacgctaatgattcaaccaagattgcttgctgatgccattgttctttttacatcaagtcaagaggaagttactcttgctgttactccactgaatttttgcctcaagagttctaatgaggaatcaatggatttgagcaatgctgtacacagtgagatgtttgttggctcagatgagtttgacttctttcaaattggaatggacactgagataacattttgtttcaaagaattgaagggaatactgacattttcagaagctacacatgctcctatatccatttattttgatttccctgggaaacctctggctttgagtattgatgatatgttagtggaagctaactttattttggccacattagctgatgaacaaagtagagcatcttcaccacagtcactgtgtctttcacagaaacgaaaaaggtcagatctgattgaaaaaaaggctggcaaaaatgtaactggccaggccctggaatgtatttcaaaaaaagcagcaccaagaaggctttatcctaaggagactctcacaaacatatctgcattggaaaactgtggcagccctgcaatgaaaagagtggatggagatgtcagtgaagtatcagaaagcagtgtcagcaacacagaggaagtgccagggtctctgtgtctcagaaagttttcttgcatgttctttggagcagtttcttctgaccagcaagaacacttcaaccaccctttcgacagtctggcaagagcaagtgacagtgaagaggacatgaataatggcagtttctctatattctaatgcttaatgatggctgagctgggccccagcccagtgactggctcatttgcccctcaagcacgagtttgcatgtttagtgtctaaaagaggttgtccaggacttccttttaatggaggatgggcttttaaaccacatcatcttgtacaacaaccatatctagaaatagctgtttgtcaagtgtatgtaacttgctttaaatccattatgctacttgtgaggcagaagagttttctgtgaaggaaaaaagcccattagagttcttcaattcaatgcacgttcaccctagagcttttaacatctttgctagttttataaaggtatttaaactttattcaacagccatttagagtgccatcaagatggcttgaaatggaattttgtgatttgtagtcaggtatcttttgtatttgattgcaaacatttggattttagttttctcatgtaataccatggccttttttgtgcattgttttttatattttaagactttaagtagaataaaccctggaaaaaagatcaagagtaaaaatatatagtcactttcacttggcttttttagacggagtctcactttgtcactcaggctcaagtgcagtggtgcaatctctgctcactgcaacatctgcctcccaggtccaagcgattctcctgcctcagcctcccgtgcagctgggattgcaggtgcgtgccaccatgcctggctaatttctggtattttgtagagacagggtttcgccatgttggccagggtggtcttgaactcctggcctcaagtgatctgcccacctcggcctcccaaagtgctgggattacagacttgagccactgcgcccaacctggagtgtttttacatattgtaaaattttatttcctaacctcaaattgttctgattttcagatgtgattttttattttgcagtgtgctgcaggaaagaatttaatggaagtgatgccaaatatttctgtattatctgacatagaacagtatcctccactgccaagacagcctgagtttggagtggaataaggtggaagacaaatgtctctgttctttggccctttaagagttagctttttacctgcacaaatggactaaaaaatctggcacaaaacattgttatgtaatgtcttatgatgtgtgcctctccctcccccaaacctgtttacagtcaattataacctgacaaacgagacttttgtaacatattattgttacatctttctgaaaccttcaaaccgtaaggaagtgttaactggcaagcagttgtactttagactttgtgagaaattcataaaggtggctgagtggatttgcatgctttagaactgtgaatagagttctaactgaaaccagaattaatttggctcttgtagcttagtaatgagtcatagctacccacaataacctaataaaaactcaagttcatcccaa

SEQ ID NO: 25379 - DNA, 2825 bp, Homo sapiens
aggacgcagcaactcacagagcaaccaggacccagaaatcgcttaagagaccgcggcaaagtaacttaactgagttgccttcttccatattttcacgcccctttcatccagaacattttttttcttgaactgcttccatggaggactcaacctccccgaagcaagaaaaagaaaaccaagaagaactaggggaaacaaggcggccatgggaaggaaagacagcagcttctccccaatattctgagcctgagtcgtctgagcccttggaggcgaagcaggggccagaaactggacgccagtcccgaagcagccgtccttggagcccgcagtctagagccaagacgcctctgggtggccccgcgggaccagaaacatcatcacctgctcctgtctctccgcgggagccctcttcctctccttctcccctggctccggccagacaagacctcgcggcaccacctcagtcggacaggaccacgagtgtgattcctgaagctgggacaccttatcctgatcctttggaacaatcatctgataaaagagaatcaactcctcatcacacaagccagtcagaaggaaacacctttcaacagtctcagcaacccaaaccccacctgtgtggacgaagggacgtgagctataacaacgctaaacagaaagagctgagatttgacgtttttcaggaggaagactcaaacagtgactatgatttacagcagccggcgcctgggggctctgaagtggcccccagcatgcttgagatcaccattcagaatgctaaggcttacctgctgaagactagcagcaattcgggctttaatctatatgatcatctttctaatatgttgaccaagatattaaatgagcgtcctgaaaatgctgttgacatctttgaaaatattagccaagatgtgaagatggcacattttagtaaaaaatttgatgcactacaaaatgagaatgagttgcttccaacatatgaaatagcagaaaagcaaaaggctctttttctccagggacatttggaaggagttgaccaagaattggaagatgaaatagcagaaaacgctcttccaaatgtaatggagtcagctttttattttgaacaagctggagttggtttgggcacagatgagacataccgcatatttcttgccctcaagcagcttactgatacccacccaatccaaagatgccgcttctggggaaagatcttgggtctggaaatgaattatattgtagctgaagtggaatttcgtgagggggaagatgaagaggaagtggaagaggaagatgtagctgaagagagggacaatggagaaagtgaagctcatgaagatgaggaagatgaattaccaaagtccttttacaaggccccacaggctataccaaaagaagaaagtagaacaggtgccaacaaatatgtctattttgtttgcaatgaaccaggaagaccatgggtgaagttaccaccagttatacctgcacaaattgttattgcaagaaaaatcaagaaatttttcactgggcgattggatgctcccatcataagctacccacctttcccaggaaatgagagtaattatttacgagcacaaattgcccgaatttcagcaggaacccacgtcagtcctctaggattttatcagtttggtgaagaggaaggagaggaggaggaagaggcagaaggtgggcgaaatagctttgaggaaaaccctgattttgaaggcatccaagtgattgatctagtagaatccctatccaattgggttcatcatgtacagcatattctctctcagggtcgctgtaattggttcaactccatacaaaaaaatgaggaagaagaagaggaagaagatgaagaaaaagacgattctgactacatagaacaggaagtggggcttcctcttttgacaccaatctctgaagatttagagattcagaatatacccccctggacaacacggttatcctcaaatctcattccacaatatgctattgcagtccttcaatccaacctttggcctggagcatatgccttctccaatggcaaaaagtttgaaaatttctacataggctggggtcataagtatagtccagacaattatacacccccagttccaccaccagtttatcaagaataccccagtggaccagaaattacagaaatggatgatcctagtgtggaggaggagcaggctttcagggctgcacaagaagcagttctactcgcagctgagaatgaagaatctgaggaagatgaagatgaggaagatgattatgactaataaacataaaattagcctggttttatgtgacactgatacacacacaccccttatatgggactaattttacacttttctgtgttatgtgtgtatatacatacacatgtaagaaattattcaactgcaaaatctcaatcttgaaaatcaagcttgaaatttcataggtagaaatattagcatttttattgaaagatactcacaggattttccagaggctaaataacatgcaattgcataattgttctgagggttatggataatggaatatgtgtttgtacattcctgtttttaaaagggctcaggtttcacatggtccaggtgaggtaaaacaattaaaataaataaataaatggtctcaggtttaatttgtaatacgacaaacactggaagatataacccacaggaaattcttggaaacatcaatactttttaaagagtgtcaaggggtatgaagacaaaaaatattgatagtcactagagtaatgtattcttaacctttgtaagaactgatctcagcatgtattcttaaacctttgt

SEQ ID NO: 25380 - DNA, 1410 bp, Homo sapiens
atggaggactcaacctccccgaagcaagaaaaagaaaaccaagaagaactaggggaaacaaggcggccatgggaaggaaagacagcagcttctccccaatattctgagcctgagtcgtctgagcccttggaggcgaagcaggggccagaaactggacgccagtcccgaagcagccgtccttggagcccgcagtctagagccaagacgcctctgggtggccccgcgggaccagaaacatcatcacctgctcctgtctctccgcgggagccctcttcctctccttctcccctggctccggccagacaagacctcgcggcaccacctcagtcggacaggaccacgagtgtgattcctgaagctgggacaccttatcctgatcctttggaacaatcatctgataaaagagaatcaactcctcatcacacaagccagtcagaaggaaacacctttcaacagtctcagcaacccaaaccccacctgtgtggacgaagggacgtgagctataacaacgctaaacagaaagagctgagatttgacgtttttcaggaggaagactcaaacagtgactatgatttacagcagccggcgcctgggggctctgaagtggcccccagcatgcttgagatcaccattcagaatgctaaggcttacctgctgaagactagcagcaattcgggctttaatctatatgatcatctttctaatatgttgaccaagatattaaatgagcgtcctgaaaatgctgttgacatctttgaaaatattagccaagatgtgaagatggcacattttagtaaaaaatttgatgcactacaaaatgagaatgagttgcttccaacatatgaaatagcagaaaagcaaaaggctctttttctccagggacatttggaaggagttgaccaagaattggaagatgaaataggtcgctgtaattggttcaactccatacaaaaaaatgaggaagaagaagaggaagaagatgaagaaaaagacgattctgactacatagaacaggaagtggggcttcctcttttgacaccaatctctgaagatttagagattcagaatatacccccctggacaacacggttatcctcaaatctcattccacaatatgctattgcagtccttcaatccaacctttggcctggagcatatgccttctccaatggcaaaaagtttgaaaatttctacataggctggggtcataagtatagtccagacaattatacacccccagttccaccaccagtttatcaagaataccccagtggaccagaaattacagaaatggatgatcctagtgtggaggaggagcaggctttcagggctgcacaagaagcagttctactcgcagctgagaatgaagaatctgaggaagatgaagatgaggaagatgattatgactaa

SEQ ID NO: 25381 - DNA, 2704 bp, Homo sapiens
atggagataggacgcagcaactcacagagcaaccaggacccagaaatcgcttaagagaccgcggcaaagtaacttaactgagttgccttcttccatattttcacgcccctttcatccagaacattttttttcttgaactgcttccatggaggactcaacctccccgaagcaagaaaaagaaaaccaagaagaactaggggaaacaaggcggccatgggaaggaaagacagcagcttctccccaatattctgagcctgagtcgtctgagcccttggaggcgaagcaggggccagaaactggacgccagtcccgaagcagccgtccttggagcccgcagtctagagccaagacgcctctgggtggccccgcgggaccagaaacatcatcacctgctcctgtctctccgcgggagccctcttcctctccttctcccctggctccggccagacaagacctcgcggcaccacctcagtcggacaggaccacgagtgtgattcctgaagctgggacaccttatcctgatcctttggaacaatcatctgataaaagagaatcaactcctcatcacacaagccagtcagaaggaaacacctttcaacagtctcagcaacccaaaccccacctgtgtggacgaagggacgtgagctataacaacgctaaacagaaagagctgagatttgacgtttttcaggaggaagactcaaacagtgactatgatttacagcagccggcgcctgggggctctgaagtggcccccagcatgcttgagatcaccattcagaatgctaaggcttacctgctgaagactagcagcaattcgggctttaatctatatgatcatctttctaatatgttgaccaagatattaaatgagcgtcctgaaaatgctgttgacatctttgaaaatattagccaagatgtgaagatggcacattttagtaaaaaatttgatgcactacaaaatgagaatgagttgcttccaacatatgaaatagcagaaaagcaaaaggctctttttctccagggacatttggaaggagttgaccaagaattggaagatgaaatagcagaaaacgctcttccaaatgtaatggagtcagctttttattttgaacaagctggagttggtttgggcacagatgagacataccgcatatttcttgccctcaagcagcttactgatacccacccaatccaaagatgccgcttctggggaaagatcttgggtctggaaatgaattatattgtagctgaagtggaatttcgtgagggggaagatgaagaggaagtggaagaggaagatgtagctgaagagagggacaatggagaaagtgaagctcatgaagatgaggaagatgaattaccaaagtccttttacaaggccccacaggctataccaaaagaagaaagtagaacaggtgccaacaaatatgtctattttgtttgcaatgaaccaggaagaccatgggtgaagttaccaccagttatacctgcacaaattgttattgcaagaaaaatcaagaaatttttcactgggcgattggatgctcccatcataagctacccacctttcccaggaaatgagagtaattatttacgagcacaaattgcccgaatttcagcaggaacccacgtcagtcctctaggattttatcagtttggtgaagaggaaggagaggaggaggaagaggcagaaggtgggcgaaatagctttgaggaaaaccctgattttgaaggcatccaagtgattgatctagtagaatccctatccaattgggttcatcatgtacagcatattctctctcagagattcagaatatacccccctggacaacacggttatcctcaaatctcattccacaatatgctattgcagtccttcaatccaacctttggcctggagcatatgccttctccaatggcaaaaagtttgaaaatttctacataggctggggtcataagtatagtccagacaattatacacccccagttccaccaccagtttatcaagaataccccagtggaccagaaattacagaaatggatgatcctagtgtggaggaggagcaggctttcagggctgcacaagaagcagttctactcgcagctgagaatgaagaatctgaggaagatgaagatgaggaagatgattatgactaataaacataaaattagcctggttttatgtgacactgatacacacacaccccttatatgggactaattttacacttttctgtgttatgtgtgtatatacatacacatgtaagaaattattcaactgcaaaatctcaatcttgaaaatcaagcttgaaatttcataggtagaaatattagcatttttattgaaagatactcacaggattttccagaggctaaataacatgcaattgcataattgttctgagggttatggataatggaatatgtgtttgtacattcctgtttttaaaagggctcaggtttcacatggtccaggtgaggtaaaacaattaaaataaataaataaatggtctcaggtttaatttgtaatacgacaaacactggaagatataacccacaggaaattcttggaaacatcaatactttttaaagagtgtcaaggggtatgaagacaaaaaatattgatagtcactagagtaatgtattcttaacctttgtaagaactgatctcagcatgtattcttaaacctttgtaattacc

SEQ ID NO: 25382 - DNA, 2489 bp, Homo sapiens
cagaaatcgcttaagagaccgcggcaaagtaacttaactgagttgccttcttccatattttcacgcccctttcatccagaacattttttttcttgaactgcttccatggaggactcaacctccccgaagcaagaaaaagaaaaccaagaagaactaggggaaacaaggcggccatgggaaggaaagacagcagcttctccccaatattctgagcctgagtcgtctgagcccttggaggcgaagcaggggccagaaactggacgccagtcccgaagcagccgtccttggagcccgcagtctagagccaagacgcctctgggtggccccgcgggaccagaaacatcatcacctgctcctgtctctccgcgggagccctcttcctctccttctcccctggctccggccagacaagacctcgcggcaccacacaagccagtcagaaggaaacacctttcaacagtctcagcaacccaaaccccacctgtgtggacgaagggacgtgagctataacaacgctaaacagaaagagctgagatttgacgtttttcaggaggaagactcaaacagtgactatgatttacagcagccggcgcctgggggctctgaagtggcccccagcatgcttgagatcaccattcagaatgctaaggcttacctgctgaagactagcagcaattcgggctttaatctatatgatcatctttctaatatgttgaccaagatattaaatgagcgtcctgaaaatgctgttgacatctttgaaaatattagccaagatgtgaagatggcacattttagtaaaaaatttgatgcactacaaaatgagaatgagttgcttccaacatatgaaatagcagaaaagcaaaaggctctttttctccagggacatttggaaggagttgaccaagaattggaagatgaaatagcagaaaacgctcttccaaatgtaatggagtcagctttttattttgaacaagctggagttggtttgggcacagatgagacataccgcatatttcttgccctcaagcagcttactgatacccacccaatccaaagatgccgcttctggggaaagatcttgggtctggaaatgaattatattgtagctgaagtggaatttcgtgagggggaagatgaagaggaagtggaagaggaagatgtagctgaagagagggacaatggagaaagtgaagctcatgaagatgaggaagatgaattaccaaagtccttttacaaggccccacaggctataccaaaagaagaaagtagaacaggtgccaacaaatatgtctattttgtttgcaatgaaccaggaagaccatgggtgaagttaccaccagttatacctgcacaaattgttattgcaagaaaaatcaagaaatttttcactgggcgattggatgctcccatcataagctacccacctttcccaggaaatgagagtaattatttacgagcacaaattgcccgaatttcagcaggaacccacgtcagtcctctaggattttatcagtttggtgaagaggaaggagaggaggaggaagaggcagaaggtgggcgaaatagctttgaggaaaaccctgattttgaaggcatccaagtgattgatctagtagaatccctatccaattgggttcatcatgtacagcatattctctctcagggtcgctgtaattggttcaactccatacaaaaaaatgaggaagaagaagaggaagaagatgaagaaaaagacgattctgactacatagaacaggaagtggggcttcctcttttgacaccaatctctgaagatttagagattcagaatatacccccctggacaacacggttatcctcaaatctcattccacaatatgctattgcagtccttcaatccaacctttggcctggagcatatgccttctccaatggcaaaaagtttgaaaatttctacataggctggggtcataagtatagtccagacaattatacacccccagttccaccaccagtttatcaagaataccccagtggaccagaaattacagaaatggatgatcctagtgtggaggaggagcaggctttcagggctgcacaagaagcagttctactcgcagctgagaatgaagaatctgaggaagatgaagatgaggaagatgattatgactaataaacataaaattagcctggttttatgtgacactgatacacacacaccccttatatgggactaattttacacttttctgtgttatgtgtgtatatacatacacatgtaagaaattattcaactgcaaaatctcaatcttgaaaatcaagcttgaaatttcataggtagaaatattagcatttttattgaaagatactcacaggattttccagaggctaaataacatgcaattgcataattgttctgagggttatggataatggaatatgtgtttgtacattcctgtttttaaaagggctcaggtttcacatggtccaggtgaggtaaaacaatt

SEQ ID NO: 25383 - DNA, 669 bp, Homo sapiens
ctcctagcaactcgacgggcgttgagcggagccgctgacctgatggacgccgacagcctcctgctgtctctggagctggcgtccggcagtgggcagggcctcagcccggaccgtcgggcctcgctgctcacgtctcttatgctggttaagcgcgactaccgctatgatcgggttctcttctggggccgcatccttggcctcgtcgccgattactacatcgcgcagggcctgagtgaggaccagctcgcaccgcgcaagacgctctatagcctgaactgcacagagtggagcctcttgccccctgccacagaggagatggtggcgcagtcgtctgtggtgaagggccgcttcatgggggacccatcatacgaatatgaacacactgagctgcagaaggtgaatgaaggtgaaaaagtctttgaagaagaaatagtggtccagatcaaggaagagacccgcttggtgtctgtcattgaccagattgacaaggctgtggccatcatcccccgaggcgccctcttcaagaccccttttggacccacccatgtcaatcggacctttgaagggtactataactggtataagacccctgcccctcacccaacctgtgatgggaatcaaggggtaagggcccgtgggcgcagccctagcctaggaaggttcctgtaa

SEQ ID NO: 25384 - DNA, 2534 bp, Homo sapiens
ggaggcggcttctcctagcaactcgacgggcgttgagcggagccgctgacctgatggacgccgacagcctcctgctgtctctggagctggcgtccggcagtgggcagggcctcagcccggaccgtcgggcctcgctgctcacgtctcttatgctggttaagcgcgactaccgctatgatcgggttctcttctggggccgcatccttggcctcgtcgccgattactacatcgcgcagggcctgagtgaggaccagctcgcaccgcgcaagacgctctatagcctgaactgcacagagtggagcctcttgccccctgccacagaggagatggtggcgcagtcgtctgtggtgaagggccgcttcatgggggacccatcatacgaatatgaacacactgagctgcagaaggtgaatgaaggtgaaaaagtctttgaagaagaaatagtggtccagatcaaggaagagacccgcttggtgtctgtcattgaccagattgacaaggctgtggccatcatcccccgaggcgccctcttcaagaccccttttggacccacccatgtcaatcggacctttgaaggactgtccttgtctgaggccaagaagctcagctcctacttccatttcagggagcctgttgagctaaagaataagaccttgcttgagaaggctgacctggacccctccctggatttcatggactccttggagcatgacattcccaaagggtcctggagcatccagatggagaggggcaatgccctggtggtgctgcgcagcctgctctggccgggcctcaccttctaccatgctccccgcaccaagaactatggctacgtctacgtgggcactggcgagaagaacatggacttgcccttcatgctatagaatgggagccagcctggatgtttttaaacagagtctaaacatgattttcttaagcttcagtgaacttggcctgcctgttctgtcctatcttcttaactccacctccgtctggttccagattctgaaaggcccactgagccagggagctcatttctaaaccaagtggcagaggggttggaatgtgctaatgaaagagattctagacaacgatgggtggaaatggctgtgggagaaggtgacaaccagggcccctttgaggaacgcagtttcttggattcacacgagagcggcaagtgtgtcaggcagcccaccttggctccctgcagctctcccacagtaaggagctcacagctgtcatgaagaggatgggacctgtttggcccatgaattcaattgactcattggccccatcacaagagatcagtgactcaatgctcagcacccagctggcaatgtgcccaggaccccctgcacttcccaagcagtgagcgcacacccaatgggtaagcccatgaacccagtttatgacactgcgttgggcaaaactcctgtccccagcactgagcatggcctaagccccatagcagctggcaagggacccaactgccctgcctgcctctagctcccagcattgctactgtgcaggccaagggtactgaagttagtcccactgtcccctgtccatgcatgttggagggaccaggccatcgtggtggggtgggacaggagtatagttgtggccaagggcttgtgagtgggcctcctactccccagcacaggtgcaggaggaactctggaagcactgctctctgtcagtgatacagcttccaaggtgttcttgagtagcagacattgtccctcagaaggggtgaccccacgggcatgcgcaccctgttccagcgggggccttttttgtagatgggcttgacggagccaggagcccagcgcgtcaggtacctgtggagggagaacaaagaggtgcctgtgagggctgggggcccaagctggacgtgggagagtggagcactacctcctcaggccaggccacggttgggcaagcaaatcctttcaccagtttccctttcctgaagtgcagggattttcctgggagtaactgctgagcgtcctgtaaacagatgggctgggctcttgctgccgcaagcctgtgtggccaggttcaggcagcccagggccacaagctcccttgatctttgtaaatgtcaatgttggtgtgtgtttgctgaggaaaaggtggcgaagaggctgcctgaagagcagatcattcctctctggcctcagccatggggcgagaagagctgatgtaaggctctggaggaacccattgctcttccccatttggctcactcagctaccccaaccttcagggaactccccagggtactataactggtataagacccctgcccctcacccaacctgtgatgggaatcaaggggtaagggcccgtgggcgcagccctagcctaggaaggttcctgtaaataggaggggggtggggaaagatggctgccgcccatggacctttggcctcctttggggatggccagggccctgatagttcccagaaaagtggctcatgccggctaggattgggttttactctgtccagaataaaacttggatcctgtcc

SEQ ID NO: 25385 - DNA, 2586 bp, Homo sapiens
ggaggcggcttctcctagcaactcgacgggcgttgagcggagccgctgacctgatggacgccgacagcctcctgctgtctctggagctggcgtccggcagtgggcagggcctcagcccggaccgtcgggcctcgctgctcacgtctcttatgctggttaagcgcgactaccgctatgatcgggttctcttctggggccgcatccttggcctcgtcgccgattactacatcgcgcagggcctgagtgaggaccagctcgcaccgcgcaagacgctctatagcctgaactgcacagagtggagcctcttgccccctgccacagaggagatggtggcgcagtcgtctgtggtgaagggccgcttcatgggggacccatcatacgaatatgaacacactgagctgcagaaggtgaatgaaggtgaaaaagtctttgaagaagaaatagtgattgacaaggctgtggccatcatcccccgaggcgccctcttcaagaccccttttggacccacccatgtcaatcggacctttgaaggactgtccttgtctgaggccaagaagctcagctcctacttccatttcagggagcctgttgagctaaagaataagaccttgcttgagaaggctgacctggacccctccctggatttcatggactccttggagcatgacattcccaaagggtctgaggcagttgttcagggtgacttcacgtggcttctgagcaggtgtggttttggttggccctgttcctgggactcctgctctgtgtccatgagggtcctggagcatccagatggagaggggcaatgccctggtggtgctgcgcagcctgctctggccgggcctcaccttctaccatgctccccgcaccaagaactatggctacgtctacgtgggcactggcgagaagaacatggacttgcccttcatgctatagaatgggagccagcctggatgtttttaaacagagtctaaacatgattttcttaagcttcagtgaacttggcctgcctgttctgtcctatcttcttaactccacctccgtctggttccagattctgaaaggcccactgagccagggagctcatttctaaaccaagtggcagaggggttggaatgtgctaatgaaagagattctagacaacgatgggtggaaatggctgtgggagaaggtgacaaccagggcccctttgaggaacgcagtttcttggattcacacgagagcggcaagtgtgtcaggcagcccaccttggctccctgcagctctcccacagtaaggagctcacagctgtcatgaagaggatgggacctgtttggcccatgaattcaattgactcattggccccatcacaagagatcagtgactcaatgctcagcacccagctggcaatgtgcccaggaccccctgcacttcccaagcagtgagcgcacacccaatgggtaagcccatgaacccagtttatgacactgcgttgggcaaaactcctgtccccagcactgagcatggcctaagccccatagcagctggcaagggacccaactgccctgcctgcctctagctcccagcattgctactgtgcaggccaagggtactgaagttagtcccactgtcccctgtccatgcatgttggagggaccaggccatcgtggtggggtgggacaggagtatagttgtggccaagggcttgtgagtgggcctcctactccccagcacaggtgcaggaggaactctggaagcactgctctctgtcagtgatacagcttccaaggtgttcttgagtagcagacattgtccctcagaaggggtgaccccacgggcatgcgcaccctgttccagcgggggccttttttgtagatgggcttgacggagccaggagcccagcgcgtcaggtacctgtggagggagaacaaagaggtgcctgtgagggctgggggcccaagctggacgtgggagagtggagcactacctcctcaggccaggccacggttgggcaagcaaatcctttcaccagtttccctttcctgaagtgcagggattttcctgggagtaactgctgagcgtcctgtaaacagatgggctgggctcttgctgccgcaagcctgtgtggccaggttcaggcagcccagggccacaagctcccttgatctttgtaaatgtcaatgttggtgtgtgtttgctgaggaaaaggtggcgaagaggctgcctgaagagcagatcattcctctctggcctcagccatggggcgagaagagctgatgtaaggctctggaggaacccattgctcttccccatttggctcactcagctaccccaaccttcagggaactccccagggtactataactggtataagacccctgcccctcacccaacctgtgatgggaatcaaggggtaagggcccgtgggcgcagccctagcctaggaaggttcctgtaaataggaggggggtggggaaagatggctgccgcccatggacctttggcctcctttggggatggccagggccctgatagttcccagaaaagtggctcatgccggctaggattgggttttactctgtccagaataaaacttggatcctgtcc

SEQ ID NO: 25386 - DNA, 550 bp, Homo sapiens
cctgaactgcacagagtggagcctcttgccccctgccacagaggagatggtggcgcagtcgtctgtggtgaagggccgcttcatgggggacccatcatacgaatatgaacacactgagctgcagaaggtgaatgaaggtgaaaaagtctttgaagaagaaatagtggtccagatcaaggaagagacccgcttggtgtctgtcattgaccagattgacaaggctgtggccatcatcccccgaggcgccctcttcaagaccccttttggacccacccatgtcaatcggacctttgaagggtactataactggtataagacccctgcccctcacccaacctgtgatgggaatcaaggggtaagggcccgtgggcgcagccctagcctaggaaggttcctgtaaataggaggggggtggggaaagatggctgccgcccatggacctttggcctcctttggggatggccagggccctgatagttcccagaaaagtggctcatgccggctaggattgggttttactctgtccagaataaaacttggatcctgtcca

SEQ ID NO: 25387 - DNA, 3519 bp, Homo sapiens
aactcagctgagtgttagtcaaagaaggtgtgtcctgctccccaatgacaggttgctcagagactgctgatttccatccctatataaagagagtccctggcatacagagactgctctgctccaggcatctgccacaatgtgggtgcttacacctgctgcttttgctgggaagctcttgagtgtgttcaggcaacctctgagctctctgtggaggagcctggtcccgctgttctgctggctgagggcaaccttctggctgctagctaccaagaggagaaagcagcagctggtcctgagagggccagatgagaccaaagaggaggaagaggaccctcctctgcccaccaccccaaccagcgtcaactatcacttcactcgccagtgcaactacaaatgcggcttctgtttccacacagccaaaacatcctttgtgctgccccttgaggaagcaaagagaggattgcttttgcttaaggaagctggtatggagaagatcaacttttcaggtggagagccatttcttcaagaccggggagaatacctgggcaagttggtgaggttctgcaaagtagagttgcggctgcccagcgtgagcatcgtgagcaatggaagcctgatccgggagaggtggttccagaattatggtgagtatttggacattctcgctatctcctgtgacagctttgacgaggaagtcaatgtccttattggccgtggccaaggaaagaagaaccatgtggaaaaccttcaaaagctgaggaggtggtgtagggattatagagtcgctttcaagataaattctgtcattaatcgtttcaacgtggaagaggacatgacggaacagatcaaagcactaaaccctgtccgctggaaagtgttccagtgcctcttaattgagggtgagaattgtggagaagatgctctaagagaagcagaaagatttgttattggtgatgaagaatttgaaagattcttggagcgccacaaagaagtgtcctgcttggtgcctgaatctaaccagaagatgaaagactcctaccttattctggatgaatatatgcgctttctgaactgtagaaagggacggaaggacccttccaagtccatcctggatgttggtgtagaagaagctataaaattcagtggatttgatgaaaagatgtttctgaagcgaggaggaaaatacatatggagtaaggctgatctgaagctggattggtagagcggaaagtggaacgagacttcaacacaccagtgggaaaactcctagagtaactgccattgtctgcaatactatcccgttggtatttcccagtggctgaaaacctgattttctgctgcacgtggcatctgattacctgtggtcactgaacacacgaataacttggatagcaaatcctgagacaatggaaaaccattaactttacttcattggcttataaccttgttgttattgaaacagcacttctgtttttgagtttgttttagctaaaaagaaggaatacacacaggaataatgaccccaaaaatgcttagataaggcccctatacacaggacctgacatttagctcaatgatgcgtttgtaagaaataagctctagtgatatctgtgggggcaaaatttaatttggatttgattttttaaaacaatgtttactgcgatttctatatttccattttgaaactatttcttgttccaggtttgttcatttgacagagtcagtattttttgccaaatatccagataaccagttttcacatctgagacattacaaagtatctgcctcaattatttctgctggttataatgcttttttttttttgcctttatgccattgcagtcttgtactttttactgtgatgtacagaaatagtcaacagatgtttccaagaacatatgatatgataatcctaccaattttcaagaagtctctagaaagagataacacatggaaagacggtgtggtgcagcccagcccacggtggctgttccatgaatgctggctacctatgtgtgtggtacctgttgtgtccctttctcttcaaagatcctgagcaaaacaaagatacgctttccatttgatgatggagttgacatggaggcagtgcttgcattgctttgttcgcctatcatctggccacatgaggctgtcaagcaaaagaataggagtgtagttgagtagctggttggccctacatctctgagaagtgacggcacactgggttggcataagatatcctaaaatcacgctggaaccttgggcaaggaagaatgtgagcaagagtagagagagtgcctggatttcatgtcagtgaagccaagtcaccatatcatatttttgaatgaactctgagtcagttgaaatagggtaccatctaggtcagtttaagaagagtcagctcagagaaagcaagcataagggaaaatgtcacgtaaactagatcagggaacaaaatcctctccttgtggaaatatcccatgcagtttgttgatacaacttagtatcttattgcctaaaaaaaaatttcttatcattgtttcaaaaaagcaaaatcatggaaaatttttgttgtccaggcaaataaaaggtcattttaatttagctgcaatttcagtgttcctcactaggtggcatttaaatgtcgcctgatgtcattaagcaccatccaaaaagtctgcttcataatctattttcaagacttggtgattctgaaagttttggtttttgtgactttgtttctcaggaaaaaaaatattcctacttaaattttaagtctataattcaatttaaatatgtgtgtgtctcatccaggataggataggttgtcttctattttccattttacctatttactttttttgtaagaaaagagaaaaatgaattctaaagatgttccccatgggttttgattgtgtctaagctatgatgaccttcatataatcagcataaacataaaacaaattttttacttaacatgagtgcactttactaatcctcatggcacagtggctcacgcctgtaatcccagcacttgggaggacaatgtgggtggatcacgaggtcaggagttcgagaacagcctggccaacatggtgaaaccccgtctccactaaaaatacaaaaattagccaggcatggtggcgtacacttgtaattccagctactcaagaggctgaggcaggaggattgcttgaaccctgaaggcagaggttacagagccaagatagcgccactgcactccagcctggatgacagagcaagactccgtctcaaaaaaaaaaaaaaaaaaaagcaagagagttcaactaagaaaggtcacatatgtgaaagcccaaggacactgtttgatatacagcaggtattcaatcagtgttatttgaaaccaaatctgaatttgaagtttgaatcttctgagttggaatgaatttttttctagctgagggaaactgtatttttctttccccaaagaggaatgtaatgtaaagtgaaataaaactataagctatgttaaataca

SEQ ID NO: 25388 - DNA, 1355 bp, Homo sapiens
gtccttgtcttcctgtctttcctagagtaccttctcaactagtaacttcagcaacatctctagcttctttccctccttgtttaactttttaacaaaagcatagcatacatgcaccagattacacatattctggatgtgcaccctgatgaatttcacaaagcaatcacagccaggtaaatagcctgcagattcagagagaaagcatcaccagcgccagaagtgcatgctgcactccagccactaccctggtatggagaagatcaacttttcaggtggagagccatttcttcaagaccggggagaatacctgggcaagttggtgaggttctgcaaagtagagttgcggctgcccagcgtgagcatcgtgagcaatggaagcctgatccgggagaggtggttccagaattatggtgagtatttggacattctcgctatctcctgtgacagctttgacgaggaagtcaatgtccttattggccgtggccaaggaaagaagaaccatgtggaaaaccttcaaaagctgaggaggtggtgtagggattatagagtcgctttcaagataaattctgtcattaatcgtttcaacgtggaagaggacatgacggaacagatcaaagcactaaaccctgtccgctggaaagtgttccagtgcctcttaattgagggtgagaattgtggagaagatgctctaagagaagcagaaagatttgttattggtgatgaagaatttgaaagattcttggagcgccacaaagaagtgtcctgcttggtgcctgaatctaaccagaagatgaaagactcctaccttattctggatgaatatatgcgctttctgaactgtagaaagggacggaaggacccttccaagtccatcctggatgttggtgtagaagaagctataaaattcagtggatttgatgaaaagatgtttctgaagcgaggaggaaaatacatatggagtaaggctgatctgaagctggattggtagagcggaaagtggaacgagacttcaacacaccagtgggaaaactcctagagtaactgccattgtctgcaatactatcccgttggtatttcccagtggctgaaaacctgattttctgctgcacgtggcatctgattacctgtggtcactgaacacacgaataacttggatagcaaatcctgagacaatggaaaaccattaactttacttcattggcttataaccttgttgttattgaaacagcacttctgtttttgagtttgttttagctaaaaagaaggaatacacacaggaataatgaccccaaaaatgcttagataaggcccctatacacaggacctgacatttagctcaatgatgcgtttgtaag

SEQ ID NO: 25389 - DNA, 6336 bp, Homo sapiens
cgccgctcaggccctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcaggtccctctgctggctccggttctgcgaggttcagccggaggcccacctgtcctgacacatctgttgctggcagcctccccacacctccagtccccagacacaggaagagccacagcctaggcaacaatatgatgtgtcagttgagtgtagttgagagtaaaagtgcgacattcccatcggagaaagcaaggcacctactggacgacagtgtcctagagtcccgcagcccccgaaggggcctggctctgacctcctcctctgctgtcaccaatggactctccctaggcagtagtgagagctcagagtttagtgaagagatgtcttcagggctggaaagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacactataaatccacacctggcaaaaaggtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggtacctgcaaaccttatgtcatttgagtaagtctctgcaggacgtggcatgacttcagaggcttctgggaacccaggctgggcctggtggtgaagagcagtcctgggcacaggctgtgagccagggtgctgggaaactcacagctggactcaggggacacggcctgtggcctcaccatcccagagggcttcaccagtgtgggatccacctgtcagtccccagcgactctcatgacactcattctgcagcaccgcctcttggggcagtggtcagaccccacacgccctctctgggcccaccacctgcatctgcgactagagagcacccggcccacgttgggttctcagtgctttctactgcacagagtggacagcgctaactaacctgtgagaggggcccgagagaaggaacagctgtggaacaggctttttacaccccaagtgcatggggttgctcgcccacagggctgcctcagattttgtacaaccccgaagcgtcctctgcgtgtgcgtgctgtacgtgtgtgtgtgtgtgtgagcgagtgtgaactcttcaagaaacatgcattttggcacaagactcgtgacatcacacacttcattcgctttgaggccctgctttaaccttaagttatagccctgtccaccgaggaaggtcagggtgagagcctagattcctcctgtgtcaagggtccctcgcattcttttactgtaaacaaacaatgccttaaattgtgtcttgttttctgttcctatgggtgctattcatctggaaggcctgcttccaggcctctttgctgtcagcccttctgagacaggacctggcttcaggactgtggactgggctgctggcctgcttgcttcctcccttccccattcctagcagggcctgaggccctcctcttctcgcccttcccaccatgccagaatgggaagttgtgacgttgcagctccaaccgacgtgctcatagtgatcagctgtgcaggagccatgaggcaccaacctctccccgcagggcaaagcctgtgcccccatcatctcactcctttgcctgcactgccagggtggggcccaccaagattcctgatcatgacgggaagctgagtgaccctgaggccttaagcttccccagtcttggccccaaatgcagtcaccagcaagttttccattttccaagtccaagggcacaattgttgatgaccgtgtgacaatagagcgaagccccggggagtgaacggtccaacctctgcattcagttaggagctcttcacatgaatcacatccttatctgtcaccttgtgtcacattttaaagtgacttttattttgcacaaataatttttattcagaataataaatcactctttatcatagtatcttctcttccctcttcccctttagtttggatagcctaactctgagaagttaacccttaaacagttttctggaagagactgaatttctgggtccttgcagctgtgatggtttcagagctcagactgatcaggcatcaagctaccctcaagagtttctgggctggatgtttcagaacaacatctacaccagtaaagtgtaataggtcagtttcaaaacgaccaaaagacccaccactgtattttgaccaaataatgacaacttctttagaaatttgaatggcttggtgaggaaagtagttgtcaccagggcctcattttgtagttgagccttacaatgcttagtagttcatcttctttttgagcaaagactagaatactttcctcctaagagaaactcccaggtgataaaagttgatgccatcaaaccttgacaccgggtgctctgcacacccacgcggatgttgcacctcattctcccgatgactattcaaatcagcatctagaggctgaatgacaatgccaaacactccacctctgatcagaaccatgcagtgttaacactttaacctacattgaatctgattctacctgttaacttttaaaaagtcgtaagtttggatgaaagtgcaagatgtggaacatcaactacctattttccttgggtttttccactctgcaaactgtcctggtttttcacaccaatgaagtattatagatgccaatccaaaacctcagaatttcaggcaccacaaaaacaggtaattttctatcccttataagtttgtcttttctttcagaaacatctcttagcctaatttgaaatagcacaatcacaattcaaaatgtttagtcttctcactaattgagtctgcttccacgtcctctcccaggaacattcttagctcggactcttgaagaatctctttagattttgttggcaaaagccttatagaagcagtaagaggcttgaccacgccggaagagtcctggagctaaagctggaagacactcagctctctaagcaggggctcggccaaacatgggagttaagtgctgcttgtcttcccagtgttggtttgaaccctgtgagcctgagacagagagggccaggcaccaaccacaaggcgggaaagtccatgggtagaccctccccctggagggaagcatttctagtttttgctccttgactgtccagagtgtacaaatgttcataacgccattgaagggattatttcttgcatgcatatgctgaatttttttaagcaaatggatcatggcaccccaaaatgaaagttatagaaagctgtctacaactgtggagttggtagctggtaacattgttgtctcaagaacaactcacctctctccctaggactaatttttgtctctctcagttgaacatgttttgtcattcaagatcagtcaggtgcattctggcaactgacatacttgatggaggattgattcggtagagagcagtagaaatcttgttctaactgtgcctggtgagagactttggccccctccctccctataaggctgtggaacctgaggaagtagatacttgaagagattctgtttaggaagaaactcactctcttttgccagttgaatttatagagcattttttttcttaccaagatggccagtatcattttacccccacctcccaagccccaagaggtgtaccttttcagatgccattttacaggcggaaatgctccatgaaacaggaagccacttgcaagcaacatctgctctgttcctcaggtggggcccagagcccttccccgagactgctgatgtctgtaaccactggggagcactgccaaaaatacagctttctggtttgtgagcccataaatgacttaaatcagctttacatcatttttacatatcaagtggtttcatgttaaaaaacaaactcctagtcctttagaaataacagattctctgcacaaaaccacccattcattcatttattcattcacagcactagcaagtgctgcctatgctgagaacaagtcagatctgatccctgccctcatggacctgaccactcaacaaacagtccccaccacacctatctccttaggcaagactttgcctctctcctagtcctgagtataaatcctgtgcatagattcctctagaaaggcatcaaaaggctcaacagactgaatggcctcttggtctgcgaaaattcagttgcaatgaggatgaagtcactatcctagaggctgcttggcccagaagagccaggcacagagctgcagttgggcacgccaaggattccaaaggtggaatgagagagtagggtcaaactgtcacagtatctgctccataggtttctgtttttaatttcaatgttaaatacaactacaatatgagcgagaactgcattttcttgggtgttgagaacttgtaccatggacttcagaccgccttgcagccgtatgctgcacaagcgtgtacaccccctgggcagcctcaaaaccccgcttacagcagcaacacaggagatcatctgtccattttagaaccattaatctctttatccattgctgaacgactgtgactattcagtaacgaagtaatagtaattaattagtatggtataatctttaataaatttcgtgccaaaatgcatggttttccacttagcattcaaaatgttgcatagagagtagttttcaatttcttatgtactcttcgaagtaagttgaaaatcagtttctacattttaattcgtttcctgttaaatctgttgcactctcctgggctgtctttttctccagcagacccctgcatgcagttgtgtaaggactttctctaattcttgtgaatcgtctcacccgcagtaaccactgaacgtcaatcagccctccatggggttctttcgatttttggtgaagtattttgttacctcagtcttgtatcaagttgctgtatttttcagcttgttacattgataataattatttcactaattaaatactttaatgtacaaacatctttgtttactttgaaattaaatgtgttttccaatg

SEQ ID NO: 25390 - DNA, 770 bp, Homo sapiens
gctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatcta

SEQ ID NO: 25391 - DNA, 2466 bp, Homo sapiens
gacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcaggtccctctgctggctccggttctgcgaggttcagccggaggcccacctgtcctgacacatctgttgctggcagcctccccacacctccagtccccagacacaggaagagccacagcctaggcaacaacaggggacgtctctatgccaccctggggcccaactggcgggttccagttaggaattctcccagaacccggagctgtgtctacagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacacgtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggaagccggagcagctccaggtccaacaggaactgacagccacgaggtggaccacctggagggcggtgcggggaaggaggcagggccctgtgcctgaagcctgggcaccatggtggccccagtcaggagcaacagtggtagccctgagtaaaacccattgtccctctttggaggagcggccagaggatgacagcagccccagcaggcagcagtgcctgggcaggctgatccagcagagcactaatgggtcagtttcatgtattggcagatgtggtgtagcatggcaaggctacaagttttaaggatttttgtctgattttcagacctggaggaggggatttttcttcctactttcccccttttttatttctaatttactttcaaccaaatattcccactatgtgctatatgtaataataaaaagttgacaacaactgaaatattcaacagcagaggatgatttaagtgaatcacagtacatccgtgtgatggaatgccaggagggtgtaagaaagagtgtgacagaaatgcatctattcacaaggaaacatcgcagtgactagagtgattttctgttctgtggaactgcatgtcctaaacttgtttttattaacactgaatacacttaaaccttatctataacatatgtataggtataaacaacagcaataaaacaccttattgccaccatgagcctaacagcagagccaccagggccttggaatgctgtccctcaccatggcctcttcctaattcggtttctctccctcccacctgtgccccagcaccactctcctgatttgtttgctgattattcctttagaattgcaggtcacgtacttgattccttcatgtgttgtctggggtgcatttttaaactttcttataaatagaaccataaagatgca

SEQ ID NO: 25392 - DNA, 1667 bp, Homo sapiens
gctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcagccatgtgagaccagaaaccagcaagccagccaacctccagcatcagagccctggcaggggacagaatggaccccagatggttcacatgaagagactttaatgaacagaaccaataaagcatggcgaggcacccatgggccggcccagggtcctggggagggtggagccctaggctaaagggcatggggaagaagtgttaccaatcccagggatggctgagttctggaggatgattggctgtgcagggtctgtgggcagggagggggaagcaggagcgagcagagaaaaatccctggcctccctttcctccagccctcagtctgccaccagagcctttcattggccaaatccaatagaaagctgggggcaaggggtccaggagatgcatctcaggggtcagcctcccccgaacagaagtggcaagtgggcagggcaaaaaatgcagctgaattgtgtgaacagactactcagcatactgccaagcctcagtgtctctatctgtaaagtgggcataaaatcttcctccttca

SEQ ID NO: 25393 - DNA, 1524 bp, Homo sapiens
gagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggtaggagtttgaattggcttatttttttttaagaaacctactcggtgccaaataagatgtttttacagtttctacctgaaaaatttccaggaagcgacatggcccgtagataaagaggcaattggttggctctttgggttggaacaggctgttggtacttcccaaggttggaaacctggattagggtgatatacaagtgatgttctgctttttatataaaagacctgtgggccccagggttccccaggctgcagcccagatgggtcacaatgagagtgataagactcgtactggttcatccacatcctcctgaactggggcatgtcaggcacaaaccctctgttctggttctctgggcattattagtatatttcatatttgtacaaataaaattatagtaatgtttatttttctggttagaaaataatgcatgttaattgtaaggaattagagaaaaaagttaatatcttttgttatctcacctaaagatatttgcttcatatcttattgatttgggcatatctaaaatatgtatgcttactctatcctaaaaatgttatttttatcttaaaaattttatctacttttcgatgctatgactcattcccatcagatggatttgtcaaactcgaatctgctct

SEQ ID NO: 25394 - DNA, 819 bp, Homo sapiens
ctgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggagaaaggctggcctgccagaatggaagactccctgcagaagtccacagtttcctccaggccacatgacacgttgcagttcaggaaaacactgcctgtgggtccaggaacctgaccctctggccttttgtctggatgccgtttgcctgctctgaagaagcgggcgttccagaaagccgaggtcaatgttggacgtcggacaaaccctgtgtgtctttgctgctccttggaatcagtgtttggccctcggagagggaagaatgtggccagcaggcagtcatttgtaaagtggagattggtttccctgacatcattaaaacccctctctcaggtca

SEQ ID NO: 25395 - DNA, 1672 bp, Homo sapiens
cctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcagtctcccatctcagcagcctgtcacatcaaggtcaagcagaagaggcaagactcaaacccacctctggccaacaccctgcctggatgtggcccagctcctcacgagtaccagcggctcccccagcatctgctgctccgcgctccccgtggcctaggaatctaagaaatgatcaaggtcaaccaggtgcagtggctctcacctgtaatcccagcactttgggaagccgaagcaggaggatcacttgagcccaggagttcaagaccagcctgggcaacatggcaaaaccccatctctacaaaagtatataaatgatctgggcatggtggtgcgtgcctacagccccagctcctcagggcttaggcgagatcgcttgatcccaggagggggaggctacagtgagccgtgatcgcgccaccgcgctccagcttgggtgacagagcaagaccttgtctcaggaaaaaaaaaaaaaa

SEQ ID NO: 25396 - DNA, 2362 bp, Homo sapiens
cgccgctcaggccctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcaggtccctctgctggctccggttctgcgaggttcagccggaggcccacctgtcctgacacatctgttgctggcagcctccccacacctccagtccccagacacaggaagagccacagcctaggcaacaacaggggacgtctctatgccaccctggggcccaactggcgggttccagttaggaattctcccagaacccggagctgtgtctacagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacactataaatccacacctggcaaaaaggtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggaagccggagcagctccaggtccaacaggaactgacagccacgaggtggaccacctggagggcggtgcggggaaggaggcagggccctgtgcctgaagcctgggcaccatggtggccccagtcaggagcaacagtggtagccctgagtaaaacccattgtccctctttggaggagcggccagaggatgacagcagccccagcaggcagcagtgcctgggcaggctgatccagcagagcactaatgggtcagtttcatgtattggcagatgtggtgtagcatggcaaggctacaagttttaaggatttttgtctgattttcagacctggaggaggggatttttcttcctactttcccccttttttatttctaatttactttcaaccaaatattcccactatgtgctatatgtaataataaaaagttgacaacaactgaaatattcaacagcagaggatgatttaagtgaatcacagtacatccgtgtgatggaatgccaggagggtgtaagaaagagtgtgacagaaatgcatctattcac

SEQ ID NO: 25397 - DNA, 4858 bp, Homo sapiens
ggaattctcccagaacccggagctgtgtctacagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacactataaatccacacctggcaaaaaggtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggtacctgcaaaccttatgtcatttgagtaagtctctgcaggacgtggcatgacttcagaggcttctgggaacccaggctgggcctggtggtgaagagcagtcctgggcacaggctgtgagccagggtgctgggaaactcacagctggactcaggggacacggcctgtggcctcaccatcccagagggcttcaccagtgtgggatccacctgtcagtccccagcgactctcatgacactcattctgcagcaccgcctcttggggcagtggtcagaccccacacgccctctctgggcccaccacctgcatctgcgactagagagcacccggcccacgttgggttctcagtgctttctactgcacagagtggacagcgctaactaacctgtgagaggggcccgagagaaggaacagctgtggaacaggctttttacaccccaagtgcatggggttgctcgcccacagggctgcctcagattttgtacaaccccgaagcgtcctctgcgtgtgcgtgctgtacgtgtgtgtgtgtgtgtgagcgagtgtgaactcttcaagaaacatgcattttggcacaagactcgtgacatcacacacttcattcgctttgaggccctgctttaaccttaagttatagccctgtccaccgaggaaggtcagggtgagagcctagattcctcctgtgtcaagggtccctcgcattcttttactgtaaacaaacaatgccttaaattgtgtcttgttttctgttcctatgggtgctattcatctggaaggcctgcttccaggcctctttgctgtcagcccttctgagacaggacctggcttcaggactgtggactgggctgctggcctgcttgcttcctcccttccccattcctagcagggcctgaggccctcctcttctcgcccttcccaccatgccagaatgggaagttgtgacgttgcagctccaaccgacgtgctcatagtgatcagctgtgcaggagccatgaggcaccaacctctccccgcagggcaaagcctgtgcccccatcatctcactcctttgcctgcactgccagggtggggcccaccaagattcctgatcatgacgggaagctgagtgaccctgaggccttaagcttccccagtcttggccccaaatgcagtcaccagcaagttttccattttccaagtccaagggcacaattgttgatgaccgtgtgacaatagagcgaagccccggggagtgaacggtccaacctctgcattcagttaggagctcttcacatgaatcacatccttatctgtcaccttgtgtcacattttaaagtgacttttattttgcacaaataatttttattcagaataataaatcactctttatcatagtatcttctcttccctcttcccctttagtttggatagcctaactctgagaagttaacccttaaacagttttctggaagagactgaatttctgggtccttgcagctgtgatggtttcagagctcagactgatcaggcatcaagctaccctcaagagtttctgggctggatgtttcagaacaacatctacaccagtaaagtgtaataggtcagtttcaaaacgaccaaaagacccaccactgtattttgaccaaataatgacaacttctttagaaatttgaatggcttggtgaggaaagtagttgtcaccagggcctcattttgtagttgagccttacaatgcttagtagttcatcttctttttgagcaaagactagaatactttcctcctaagagaaactcccaggtgataaaagttgatgccatcaaaccttgacaccgggtgctctgcacacccacgcggatgttgcacctcattctcccgatgactattcaaatcagcatctagaggctgaatgacaatgccaaacactccacctctgatcagaaccatgcagtgttaacactttaacctacattgaatctgattctacctgttaacttttaaaaagtcgtaagtttggatgaaagtgcaagatgtggaacatcaactacctattttccttgggtttttccactctgcaaactgtcctggtttttcacaccaatgaagtattatagatgccaatccaaaacctcagaatttcaggcaccacaaaaacaggtaattttctatcccttataagtttgtcttttctttcagaaacatctcttagcctaatttgaaatagcacaatcacaattcaaaatgtttagtcttctcactaattgagtctgcttccacgtcctctcccaggaacattcttagctcggactcttgaagaatctctttagattttgttggcaaaagccttatagaagcagtaagaggcttgaccacgccggaagagtcctggagctaaagctggaagacactcagctctctaagcaggggctcggccaaacatgggagttaagtgctgcttgtcttcccagtgttggtttgaaccctgtgagcctgagacagagagggccaggcaccaaccacaaggcgggaaagtccatgggtagaccctccccctggagggaagcatttctagtttttgctccttgactgtccagagtgtacaaatgttcataacgccattgaagggattatttcttgcatgcatatgctgaatttttttaagcaaatggatcatggcaccccaaaatgaaagttatagaaagctgtctacaactgtggagttggtagctggtaacattgttgtctcaagaacaactcacctctctccctaggactaatttttgtctctctcagttgaacatgttttgtcattcaagatcagtcaggtgcattctggcaactgacatacttgatggaggattgattcggtagagagcagtagaaatcttgttctaactgtgcctggtgagagactttggccccctccctccctataaggctgtggaacctgaggaagtagatacttgaagagattctgtttaggaagaaactcactctcttttgccagttgaatttatagagcattttttttcttaccaagatggccagtatcattttacccccacctcccaagccccaagaggtgtaccttttcagatgccattttacaggcggaaatgctccatgaaacaggaagccacttgcaagcaacatctgctctgttcctcaggtggggcccagagcccttccccgagactgctgatgtctgtaaccactggggagcactgccaaaaatacagctttctggtttgtgagcccataaatgacttaaatcagctttacatcatttttacatatcaagtggtttcatgttaaaaaacaaactcctagtcctttagaaataacagattctctgcacaaaaccacccattcattcatttattcattcacagcactagcaagtgctgcctatgctgagaacaagtcagatctgatccctgccctcatggacctgaccactcaacaaacagtccccaccacacctatctccttaggcaagactttgcctctctcctagtcctgagtataaatcctgtgcatagattcctctagaaaggcatcaaaaggctcaacagactgaatggcctcttggtctgcgaaaattcagttgcaatgaggatgaagtcactatcctagaggctgcttggcccagaagagccaggcacagagctgcagttgggcacgccaaggattccaaaggtggaatgagagagtagggtcaaactgtcacagtatctgctccataggtttctgtttttaatttcaatgttaaatacaactacaatatgagcgagaactgcattttcttgggtgttgagaacttgtaccatggacttcagaccgccttgcagccgtatgctgcacaagcgtgtacaccccctgggcagcctcaaaaccccgcttacagcagcaacacaggagatcatctgtccattttagaaccattaatctctttatccattgctgaacgactgtgactattcagtaacgaagtaatagtaattaattagtatggtataatctttaataaatttcgtgccaaaatgcatggttttccacttagcattcaaaatgttgcatagagagtagttttcaatttcttatgtactcttcgaagtaagttgaaaatcagtttctacattttaattcgtttcctgttaaatctgttgcactctcctgggctgtctttttctccagcagacccctgcatgcagttgtgtaaggactttctctaattcttgtgaatcgtctcacccgcagtaaccactgaacgtcaatcagccctccatggggttctttcgatttttggtgaagtattttgttacctcagtcttgtatcaagttgctgtatttttcagcttgttacattgataataattatttcactaattaaatactttaatgtacaaacatctttgtttactttgaaattaaatgtgttttccaatgaa

SEQ ID NO: 25398 - DNA, 8004 bp, Homo sapiens
agggagagagttgtgctcctgccgccgagagctccaccttcgtggctctgggtccggggccccggcctgtggcggcgagcggcggccgctggagacgagcggcggcggcaggcggccagcccgggtctgcctcgctccgtgcagggccgggagagggatccgccatattggagctggggccgaaggtgccttggagccgcggcgcgaggcgggtggaggtggcggccctggcctggatcgggaaggagtcggctctgccctggcccgcaaggctggggagctaatgagcctctctggctagtctcctccccgtccactccctccactttctgccgccgggacccggctgggagccggctgtggcagtggcagtggcagtggcagcgacaggatgttctccaagaagccgcacggggacgtgaagaagtccacccagaaggtgctagacaccaagaaggacgcactgactcgcctcaagcacctgcgcatcgtcatcgagaatgcagaatctattgatcttaaacagtttttcgaccaacatttttcacatatatactatgtgttctttgaaaattttgtgactattgaagctagtcttaaacagaaaggtcacaagtctcaaagagaggaattggatgctatactttttatttttgagaaaattttacaacttcttccagaaagaattcatcagcgatggcagtttcatagtattggattgattttaaagaagctacttcacacaggaaactccttaaagattaggcgggaaggtgttcgtcttttcttactatggttgcaagctcttcagaataactgtagcaaagaacagctctggatgttttcatgcttaatccctggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgccatgagaagccgatccattggtgaatgtgctctgccatcggcctatatacgcagtgctaaaagtgctcctgttctgatccatacttccaaacccttcttgcctgatattgttctcactcccctttctgatgagctttcagatattgatgatgctcaaatacttccccgctcaactagagtcagacatttttcacaaagtgaagaaactggaaatgaagtttttggtgctttgaatgaggagcagccattgcctcgaagtagcagcacttctgacatcttggaaccattcactgttgaacgagccaaagtcaataaagaggacatgagccaaaaactgcctcctcttaatagtgatattggcggcagcagtgctaatgttcctgatctgatggatgagtttatagcagaacgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccgaaaatttgacaattttggctttggaaccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggttcagaaagtgcttccccagtccactcacctctgggctccaggtcacagactccttccccttctacattgaatatagatcacatggaacagaaggatctgcagctcgacgagaagctccaccactctgttcttcagacaccagatgatctagaaattagtgaatttccatcagaatgttgtagtgtgatggcaggaggtactctgactggatggcatgctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactgagaattcttacaccttggctttttaaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaaggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctatcc

SEQ ID NO: 25399 - DNA, 7911 bp, Homo sapiens
atcactaccacactcgtctccgtttcggcctctgcagggtgtaagctgctaaagaagcttcaaccttaagggggcctcagggagagagttgtgctcctgccgccgagagctccaccttcgtggctctgggtccggggccccggcctgtggcggcgagcggcggccgctggagacgagcggcggcggcaggcggccagcccgggtctgcctcgctccgtgcagggccgggagagggatccgccatattggagctggggccgaaggtgccttggagccgcggcgcgaggcgggtggaggtggcggccctggcctggatcgggaaggagtcggctctgccctggcccgcaaggctggggagctaatgagcctctctggctagtctcctccccgtccactccctccactttctgccgccgggacccggctgggagccggctgtggcagtggcagtggcagtggcagcgacaggatgttctccaagaagccgcacggggacgtgaagaagtccacccagaaggtgctagacaccaagaaggacgcactgactcgcctcaagcacctgcgcatcgtcatcgagaatgcagaatctattgatcttaaacagtttttcgaccaacatttttcacatatatactatgtgttctttgaaaattttgtgactattgaagctagtcttaaacagaaaggtcacaagtctcaaagagaggaattggatgctatactttttatttttgagaaaattttacaacttcttccagaaagaattcatcagcgatggcagtttcatagtattggattgattttaaagaagctacttcacacaggaaactccttaaagattaggcgggaaggtgttcgtcttttcttactatggttgcaagctcttcagaataactgtagcaaagaacagctctggatgttttcatgcttaatccctggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgatattgatgatgctcaaatacttccccgctcaactagagtcagacatttttcacaaagtgaagaaactggaaatgaagtttttggtgctttgaatgaggagcagccattgcctcgaagtagcagcacttctgacatcttggaaccattcactgttgaacgagccaaagtcaataaagaggacatgagccaaaaactgcctcctcttaatagtgatattggcggcagcagtgctaatgttcctgatctgatggatgagtttatagcagaacgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccgaaaatttgacaattttggctttggaaccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggttcagaaagtgcttccccagtccactcacctctgggctccaggtcacagactccttccccttctacattgaatatagatcacatggaacagaaggatctgcagctcgacgagaagctccaccactctgttcttcagacaccagatgatctagaaattagtgaatttccatcagaatgttgtagtgtgatggcaggaggtactctgactggatggcatgctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactgagaattcttacaccttggctttttaaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctatcca

SEQ ID NO: 25400 - DNA, 7900 bp, Homo sapiens
agggagagagttgtgctcctgccgccgagagctccaccttcgtggctctgggtccggggccccggcctgtggcggcgagcggcggccgctggagacgagcggcggcggcaggcggccagcccgggtctgcctcgctccgtgcagggccgggagagggatccgccatattggagctggggccgaaggtgccttggagccgcggcgcgaggcgggtggaggtggcggccctggcctggatcgggaaggagtcggctctgccctggcccgcaaggctggggagctaatgagcctctctggctagtctcctccccgtccactccctccactttctgccgccgggacccggctgggagccggctgtggcagtggcagtggcagtggcagcgacaggatgttctccaagaagccgcacggggacgtgaagaagtccacccagaaggtgctagacaccaagaaggacgcactgactcgcctcaagcacctgcgcatcgtcatcgagaatgcagaatctattgatcttaaacagtttttcgaccaacatttttcacatatatactatgtgttctttgaaaattttgtgactattgaagctagtcttaaacagaaaggtcacaagtctcaaagagaggaattggatgctatactttttatttttgagaaaattttacaacttcttccagaaagaattcatcagcgatggcagtttcatagtattggattgattttaaagaagctacttcacacaggaaactccttaaagattaggcgggaaggtgttcgtcttttcttactatggttgcaagctcttcagaataactgtagcaaagaacagctctggatgttttcatgcttaatccctggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgatattgatgatgctcaaatacttccccgctcaactagagtcagacatttttcacaaagtgaagaaactggaaatgaagtttttggtgctttgaatgaggagcagccattgcctcgaagtagcagcacttctgacatcttggaaccattcactgttgaacgagccaaagtcaataaagaggacatgagccaaaaactgcctcctcttaatagtgatattggcggcagcagtgctaatgttcctgatctgatggatgagtttatagcagaacgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccgaaaatttgacaattttggctttggaaccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggttcagaaagtgcttccccagtccactcacctctgggctccaggtcacagactccttccccttctacattgaatatagatcacatggaacagaaggatctgcagctcgacgagaagctccaccactctgttcttcagacaccagatgatctagaaattagtgaatttccatcagaatgttgtagtgtgatggcaggaggtactctgactggatggcatgctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactgagaattcttacaccttggctttttaaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgaagaaagaaatgcagtgatagttctcttcctcccaaaacctccgctagaaaacattggccatctcaaggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctatcc

SEQ ID NO: 25401 - DNA, 6328 bp, Homo sapiens
tctggctagtctcctccccgtccactccctccactttctgccgccgggacccggctgggagccggctgtggcagtggcagtggcagtggcagcgacaggatgttctccaagaagccgcacggggacgtgaagaagtccacccagaaggtgctagacaccaagaaggacgcactgactcgcctcaagcacctgcgcatcgtcatcgagaatgcagaatctattgatcttaaacagtttttcgaccaacatttttcacatatatactatgtgttctttgaaaattttgtgactattgaagctagtcttaaacagaaaggtcacaagtctcaaagagaggaattggatgctatactttttatttttgagaaaattttacaacttcttccagaaagaattcatcagcgatggcagtttcatagtattggattgattttaaagaagctacttcacacaggaaactccttaaagattaggcgggaaggtgttcgtcttttcttactatggttgcaagctcttcagaataactgtagcaaagaacagctctggatgttttcatgcttaatccctggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgatattgatgatgctcaaatacttccccgctcaactagagtcagacatttttcacaaagtgaagaaactggaaatgaagtttttggtgctttgaatgaggagcagccattgcctcgaagtagcagcacttctgacatcttggaaccattcactgttgaacgagccaaagaggcagaacagaatgccaccagaggctccactgagggatctgtacagtcatgtaatgggctattttggaaggaaagctgcagtgatattggcggcagcagtgctaatgttcctgatctgatggatgagtttatagcagaacgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccgaaaatttgacaattttggctttggaaccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggttcagaaagtgcttccccagtccactcacctctgggctccaggtcacagactccttccccttctacattgaatatagatcacatggaacagaaggatctgcagctcgacgagaagctccaccactctgttcttcagacaccagatgatctagaaattagtgaatttccatcagaatgttgtagtgtgatggcaggaggtactctgactggatggcatgctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactgagaattcttacaccttggctttttaaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaaggctcctacccagagattctacccagtgaaactcccacagcaacgcaggtagatggg

SEQ ID NO: 25402 - DNA, 7864 bp, Homo sapiens
agggagagagttgtgctcctgccgccgagagctccaccttcgtggctctgggtccggggccccggcctgtggcggcgagcggcggccgctggagacgagcggcggcggcaggcggccagcccgggtctgcctcgctccgtgcagggccgggagagggatccgccatattggagctggggccgaaggtgccttggagccgcggcgcgaggcgggtggaggtggcggccctggcctggatcgggaaggagtcggctctgccctggcccgcaaggctggggagctaatgagcctctctggctagtctcctccccgtccactccctccactttctgccgccgggacccggctgggagccggctgtggcagtggcagtggcagtggcagcgacaggatgttctccaagaagccgcacggggacgtgaagaagtccacccagaaggtgctagacaccaagaaggacgcactgactcgcctcaagcacctgcgcatcgtcatcgagaatgcagaatctattgatcttaaacagtttttcgaccaacatttttcacatatatactatgtgttctttgaaaattttgtgactattgaagctagtcttaaacagaaaggtcacaagtctcaaagagaggaattggatgctatactttttatttttgagaaaattttacaacttcttccagaaagaattcatcagcgatggcagtttcatagtattggattgattttaaagaagctacttcacacaggaaactccttaaagattaggcgggaaggtgttcgtcttttcttactatggttgcaagctcttcagaataactgtagcaaagaacagctctggatgttttcatgcttaatccctggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgatattgatgatgctcaaatacttccccgctcaactagagtcagacatttttcacaaagtgaagaaactggaaatgaagtttttggtgctttgaatgaggagcagccattgcctcgaagtagcagcacttctgacatcttggaaccattcactgttgaacgagccaaagtcaataaagaggacatgagccaaaaactgcctcctcttaatagtgatattggcggcagcagtgctaatgttcctgatctgatggatgagtttatagcagaacgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccgaaaatttgacaattttggctttggaaccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggttcagaaagtgcttccccagtccactcacctctgggctccaggtcacagactccttccccttctacattgaatatagatcacatggaacagaaggatctgcagctcgacgagaagctccaccactctgttcttcagacaccagatgatctagaaattagtgaatttccatcagaatgttgtagtgtgatggcaggaggtactctgactggatggcatgctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactgagaattcttacaccttggctttttaaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaaggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctatcca

SEQ ID NO: 25403 - DNA, 6250 bp, Homo sapiens
atgttctccaagaagccgcacggggacgtgaagaagtccacccagaaggtgctagacaccaagaaggacgcactgactcgcctcaagcacctgcgcatcgtcatcgagaatgcagaatctattgatcttaaacagtttttcgaccaacatttttcacatatatactatgtgttctttgaaaattttgtgactattgaagctagtcttaaacagaaaggtcacaagtctcaaagagaggaattggatgctatactttttatttttgagaaaattttacaacttcttccagaaagaattcatcagcgatggcagtttcatagtattggattgattttaaagaagctacttcacacaggaaactccttaaagattaggcgggaaggtgttcgtcttttcttactatggttgcaagctcttcagaataactgtagcaaagaacagctctggatgttttcatgcttaatccctggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgccatgagaagccgatccattggtgaatgtgctctgccatcggcctatatacgcagtgctaaaagtgctcctgttctgatccatacttccaaacccttcttgcctgatattgttctcactcccctttctgatgagctttcagatattgatgatgctcaaatacttccccgctcaactagagtcagacatttttcacaaagtgaagaaactggaaatgaagtttttggtgctttgaatgaggagcagccattgcctcgaagtagcagcacttctgacatcttggaaccattcactgttgaacgagccaaagtcaataaagaggacatgagccaaaaactgcctcctcttaatagtgatattggcggcagcagtgctaatgttcctgatctgatggatgagtttatagcagaacgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccgaaaatttgacaattttggctttggaaccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggttcagaaagtgcttccccagtccactcacctctgggctccaggtcacagactccttccccttctacattgaatatagatcacatggaacagaaggatctgcagctcgacgagaagctccaccactctgttcttcagacaccagatgatctagaaattagtgaatttccatcagaatgttgtagtgtgatggcaggaggtactctgactggatggcatgctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactgagaattcttacaccttggctttttaaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcatt

SEQ ID NO: 25404 - DNA, 3354 bp, Homo sapiens
cagatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgttggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcct

SEQ ID NO: 25405 - DNA, 3598 bp, Homo sapiens
gcgcccgcgctgcgagccttccatggtgcagcgcatgtgggccgaggcggccgggcctgctggcggcgccgagccgctgtttccgggctcccggcggagccgcagcgtgtgggacgccgtgcgcctggaggtgggcgtccccgacagctgcccggtggtgctgcacagcttcacgcagctagaccccgacctgccgcgcccggagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactata

SEQ ID NO: 25406 - DNA, 3634 bp, Homo sapiens
gcgcccgcgctgcgagccttccatggtgcagcgcatgtgggccgaggcggccgggcctgctggcggcgccgagccgctgtttccgggctcccggcggagccgcagcgtgtgggacgccgtgcgcctggaggtgggcgtccccgacagctgcccggtggtgctgcacagcttcacgcagctagaccccgacctgccgcgcccggagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggcctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactata

SEQ ID NO: 25407 - DNA, 3452 bp, Homo sapiens
cgagcggccggagcgcggcgcggcgcagacaatgggagcggcgctggcggctgccggggcggccccgagggccgcagagtcctgggcccggcggggaccggaggccgcgccatgagccccgcagccgggcgcacccctgcgccgcgcgcgggcccaggcgagcggcctctgcgagccccgggtcccgccctggggccggcgatgtgccaccgaggctgaggatgatggtagattgccagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggcctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactata

SEQ ID NO: 25408 - DNA, 2919 bp, Homo sapiens
agtgtctgggcgggaagccgggccccagggcctgatgtgcctgtgggggcactccacagcccctgcccacaccctctcctccccgcctctgctgttctgctccctgccctgtgccctccacttgcagccagggactgggcatccacccggccaggttcccaggaagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccaga

SEQ ID NO: 25409 - DNA, 3691 bp, Homo sapiens
actccactagggcacgcaggcgacgagcacactggcagagggcctcccgcagggcccactccccacctggctctcgccccaccatggcccgggaagcaggccaggtttgtgccaggcctgccgtgcccagggggaggaagggctctgtgttctttgcctgtgtctctgtggtgaccgccaggagaagggccgtcgcccgtcgtgccgctctccaaagcccgacaccttggctggcacctctgccagcaccggccaccaccgagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggcctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactat

SEQ ID NO: 25410 - DNA, 3801 bp, Homo sapiens
ccgagcgcgtccccgagctcacgcggcggggcgcgcccctcgcacctgcgggcgggctggggcggggccgcggctgtccccgcccacccgggcccgagcccggggagccggggcggaaccgagcggcgaggcccgagcggccggagcgcggcgcggcgcagacaatgggagcggcgctggcggctgccggggcggccccgagggccgcagagtcctgggcccggcggggaccggaggccgcgccatgagccccgcagccgggcgcacccctgcgccgcgcgcgggcccaggcgagcggcctctgcgagccccgggtcccgccctggggccggcgatgtgccaccgaggctgaggatgatggtagattgccagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggcctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactata

SEQ ID NO: 25411 - DNA, 926 bp, Homo sapiens
gtggttgcagagaacgggctgagtgaggagaagcctcacctcttggtgttccctccagatctggtggcagagcagtttacactgatggatgcggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagac

SEQ ID NO: 25412 - DNA, 3705 bp, Homo sapiens
ctcttttctgtctggcccgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttacccatgatgatggctctttcttgcctctgccaccagcaacatgaagctgcactacaagagggagaagccactccagcccgtggtatggtcacagtaccctcagcccaagctgctggagcacaggcccacacagctgctgacactcacaccctggttggcgcccatcgtctccgagggaaccttcaacccagagcttctgcagcacatctaccagccactgaacctgaccattggggtcacggtgtttgccgtggggaaagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggcctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctca

SEQ ID NO: 25413 - DNA, 5113 bp, Homo sapiens
agaaacgcttttctgcggtccagtctagggggtctcagattggcggggatgggcagcagcggcaggtggccttggcttttgctgcagccgtcaacgacctatcatcggggtcctgcgtaaggtccggctggctgggacttggctgtgggtgggatggactggctgccggaccgagtgccctgcagttggtaggagtatgaggcagagtgatgcacacccgggcgcccagcatcgttctaattgccggagacattgcctcagactgtgcgctgctagaggctgcgttcctgagcaggaagcccgtttcctgggattggaactacccttcttggccagcgggaagtccccaaggacggagtcgaaaggtcaaatcttatctgtcagtgctgtgtgacagcatcgcaacgggatctgcagaacctgaactcgatccgtaatgcctcctgcctgcctctttcaagatggaggtgaaacctgtgggagaacctactcaagaggtgtctaaattcaaactttccaccaaggtagaaagcacgggacactggctggtggaagatcatgttcgaatatgggaagttttaaagacagaggagagctcgattcaggactggggtgaagaggtagaggaaggagctgtttaccatgtcaccctcaaaagagtccagattcaacaggctgccaataaaggagcaagatggctaggggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtatggaaacctgacaagcccaaactgtgaagaagatggaagccaaagttcatcagagtccaaaatggtgatcaggaatgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacaatgggcttcccaacacgatctccttcagcctggaagaggaagaggaactggagggtggagagtcagcagaattcacgtgcttctcagaagatctcgtggcagagcagctgacctacatggatgcacaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgaatgtagactcctgaagaatttttcctccttgagggccatcgtttcggcactgcagtctaattccatctatcggttaaaaaagacttgggctgccgtcccaagggaccgaatgctgatgtttgaagaactttcagatatcttctcagaccataataaccatttgaccagccgagaactactgatgaaggaaggaacctcaaaatttgcaaacctggacagcagtgtgaaagaaaaccagaagcgtacccagaggcggctgcagctccagaaggacatgggtgtgatgcagggaactgtgccctacctgggcaccttcctgactgacctgaccatgcttgacactgcccttcaggactacatcgagggtggactgataaactttgagaaaaggagaagggaatttgaagtgattgcccagataaagctcttacagtctgcctgcaacagctattgcatgaccccagaccaaaagttcatccagtggttccagaggcagcagctcctgacagaggaggagagctatgccctgtcatgtgagattgaagcagctgctgacgccagcaccacctcgcccaagcctcggaagagcatggtgaagagactcagcctactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatgttgacgagccaggataaaacccccgctgtgatccagagagccatgctgaagcacaatctggactcagaccccgccgaggagtacgagctggtgcaggtcatctcggaggacaaagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcttaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaaggga

SEQ ID NO: 25414 - DNA, 4724 bp, Homo sapiens
gtggcccgagtcgcgcgcaccggcggcggcgggggcagcgcggcgcgtgtctgtgcgctgcggtcgctcgggaccgggaccggggcgaggcgccgcggggctgagcccagcagacattgcgttggcctccgagcagggcgcatcatgcagcgttcgcgcaccggagagaaaactgagaatgaaattgctttggcaagctaaaatgagctcgattcaggactggggtgaagaggtagaggaaggagctgtttaccatgtcaccctcaaaagagtccagattcaacaggctgccaataaaggagcaagatggctaggggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtatggaaacctgacaagcccaaactgtgaagaagatggaagccaaagttcatcagagtccaaaatggtgatcaggaatgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacaatgggcttcccaacacgatctccttcagcctggaagaggaagaggaactggagggtggagagtcagcagaattcacgtgcttctcagaagatctcgtggcagagcagctgacctacatggatgcacaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgaatgtagactcctgaagaatttttcctccttgagggccatcgtttcggcactgcagtctaattccatctatcggttaaaaaagacttgggctgccgtcccaagggaccgaatgctgatgtttgaagaactttcagatatcttctcagaccataataaccatttgaccagccgagaactactgatgaaggaaggaacctcaaaatttgcaaacctggacagcagtgtgaaagaaaaccagaagcgtacccagaggcggctgcagctccagaaggacatgggtgtgatgcagggaactgtgccctacctgggcaccttcctgactgacctgaccatgcttgacactgcccttcaggactacatcgagggtggactgataaactttgagaaaaggagaagggaatttgaagtgattgcccagataaagctcttacagtctgcctgcaacagctattgcatgaccccagaccaaaagttcatccagtggttccagaggcagcagctcctgacagaggaggagagctatgccctgtcatgtgagattgaagcagctgctgacgccagcaccacctcgcccaagcctcggaagagcatggtgaagagactcagcctactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatgttgacgagccaggataaaacccccgctgtgatccagagagccatgctgaagcacaatctggactcagaccccgccgaggagtacgagctggtgcaggtcatctcggaggacaaagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcttaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaaggg

SEQ ID NO: 25415 - DNA, 5068 bp, Homo sapiens
ctgcggtccagtctagggggtctcagattggcggggatgggcagcagcggcaggtggccttggcttttgctgcagccgtcaacgacctatcatcggggtcctgcgtaaggtccggctggctgggacttggctgtgggtgggatggactggctgccggaccgagtgccctgcagttggtaggagtatgaggcagagtgatgcacacccgggcgcccagcatcgttctaattgccggagacattgcctcagactgtgcgctgctagaggctgcgttcctgagcaggaagcccgtttcctgggattggaactacccttcttggccagcgggaagtccccaaggacggagtcgaaaggtcaaatcttatctgtcagtgctgtgtgacagcatcgcaacgggatctgcagaacctgaactcgatggaggtgaaacctgtgggagaacctactcaagaggtgtctaaattcaaactttccaccaaggtagaaagcacgggacactggctggtggaagatcatgttcgaatatgggaagttttaaagacagaggagagctcgattcaggactggggtgaagaggtagaggaaggagctgtttaccatgtcaccctcaaaagagtccagattcaacaggctgccaataaaggagcaagatggctaggggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtatggaaacctgacaagcccaaactgtgaagaagatggaagccaaagttcatcagagtccaaaatggtgatcaggaatgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacaatgggcttcccaacacgatctccttcagcctggaagaggaagaggaactggagggtggagagtcagcagaattcacgtgcttctcagaagatctcgtggcagagcagctgacctacatggatgcacaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgaatgtagactcctgaagaatttttcctccttgagggccatcgtttcggcactgcagtctaattccatctatcggttaaaaaagacttgggctgccgtcccaagggaccgaatgctgatgtttgaagaactttcagatatcttctcagaccataataaccatttgaccagccgagaactactgatgaaggaaggaacctcaaaatttgcaaacctggacagcagtgtgaaagaaaaccagaagcgtacccagaggcggctgcagctccagaaggacatgggtgtgatgcagggaactgtgccctacctgggcaccttcctgactgacctgaccatgcttgacactgcccttcaggactacatcgagggtggactgataaactttgagaaaaggagaagggaatttgaagtgattgcccagataaagctcttacagtctgcctgcaacagctattgcatgaccccagaccaaaagttcatccagtggttccagaggcagcagctcctgacagaggaggagagctatgccctgtcatgtgagattgaagcagctgctgacgccagcaccacctcgcccaagcctcggaagagcatggtgaagagactcagcctactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatgttgacgagccaggataaaacccccgctgtgatccagagagccatgctgaagcacaatctggactcagaccccgccgaggagtacgagctggtgcaggtcatctcggaggacaaagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcttaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaaggg

SEQ ID NO: 25416 - DNA, 3203 bp, Homo sapiens
agattggcggggatgggcagcagcggcaggtggccttggcttttgctgcagccgtcaacgacctatcatcggggtcctgcgtaaggtccggctggctgggacttggctgtgggtgggatggactggctgccggaccgagtgccctgcagttggtaggagtatgaggcagagtgatgcacacccgggcgcccagcatcgttctaattgccggagacattgcctcagactgtgcgctgctagaggctgcgttcctgagcaggaagcccgtttcctgggattggaactacccttcttggccagcgggaagtccccaaggacggagtcgaaaggtcaaatcttatctgtcagtgctgtgtgacagcatcgcaacgggatctgcagaacctgaactcgtgtgcagtttcctcaagggcagagattttgtccatcttgtccactactatatgccaagtgtttggaacagtttgcacggaggaatggttcctgaatgaattgaatgcatgatccgtaatgcctcctgcctgcctctttcaagatggaggtgaaacctgtgggagaacctactcaagaggtgtctaaattcaaactttccaccaaggtagaaagcacgggacactggctggtggaagatcatgttcgaatatgggaagttttaaagacagaggaggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtatggaaacctgacaagcccaaactgtgaagaagatggaagccaaagttcatcagagtccaaaatggtgatcaggaatgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacaatgggcttcccaacacgatctccttcagcctggaagaggaagaggaactggagggtggagagtcagcagaattcacgtgcttctcagaagatctcgtggcagagcagctgacctacatggatgcacaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgaatgtagactcctgaagaatttttcctccttgagggccatcgtttcggcactgcagtctaattccatctatcggttaaaaaagacttgggctgccgtcccaagggaccgaatgctgatgtttgaagaactttcagatatcttctcagaccataataaccatttgaccagccgagaactactgatgaaggaaggaacctcaaaatttgcaaacctggacagcagtgtgaaagaaaaccagaagcgtacccagaggcggctgcagctccagaaggacatgggtgtgatgcagggaactgtgccctacctgggcaccttcctgactgacctgaccatgcttgacactgcccttcaggactacatcgagggtggactgataaactttgagaaaaggagaagggaatttgaagtgattgcccagataaagctcttacagtctgcctgcaacagctattgcatgaccccagaccaaaagttcatccagtggttccagaggcagcagctcctgacagaggaggagagctatgccctgtcatgtgagattgaagcagctgctgacgccagcaccacctcgcccaagcctcggaagagcatggtgaagagactcagcctactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatgttgacgagccaggataaaacccccgctgtgatccagagagccatgctgaagcacaatctggactcagaccccgccgaggagtacgagctggtgcaggtcatctcggaggacaaagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcct

SEQ ID NO: 25417 - DNA, 2688 bp, Homo sapiens
agcgcggcgcgtgtctgtgcgctgcggtcgctcgggaccgggaccggggcgaggcgccgcggggctgagcccagcagacattgcgttggcctccgagcagggcgcatcatgcagcgttcgcgcaccggagagaaaactgagaatgaaattgctttggcaagctaaaatgagctcgattcaggactggggtgaagaggtagaggaaggagctgtttaccatgtcaccctcaaaagagtccagattcaacaggctgccaataaaggagcaagatggctaggggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtatggaaacctgacaagcccaaactgtgaagaagatggaagccaaagttcatcagagtccaaaatggtgatcaggaatgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacaatgggcttcccaacacgatctccttcagcctggaagaggaagaggaactggagggtggagagtcagcagaattcacgtgcttctcagaagatctcgtggcagagcagctgacctacatggatgcacaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgaatgtagactcctgaagaatttttcctccttgagggccatcgtttcggcactgcagtctaattccatctatcggttaaaaaagacttgggctgccgtcccaagggaccgaatgctgatgtttgaagaactttcagatatcttctcagaccataataaccatttgaccagccgagaactactgatgaaggaaggaacctcaaaatttgcaaacctggacagcagtgtgaaagaaaaccagaagcgtacccagaggcggctgcagctccagaaggacatgggtggactgataaactttgagaaaaggagaagggaatttgaagtgattgcccagataaagctcttacagtctgcctgcaacagctattgcatgaccccagaccaaaagttcatccagtggttccagaggcagcagctcctgacagaggaggagagctatgccctgtcatgtgagattgaagcagctgctgacgccagcaccacctcgcccaagcctcggaagagcatggtgaagagactcagcctactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatgttgacgagccaggataaaacccccgctgtgatccagagagccatgctgaagcacaatctggactcagaccccgccgaggagtacgagctggtgcaggtcatctcggaggacaaagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgg

SEQ ID NO: 25418 - DNA, 1721 bp, Homo sapiens
taggagtatgaggcagagtgatgcacacccgggcgcccagcatcgttctaattgccggagacattgcctcagactgtgcgctgctagaggctgcgttcctgagcaggaagcccgtttcctgggattggaactacccttcttggccagcgggaagtccccaaggacggagtcgaaaggtcaaatcttatctgtcagtgctgtgtgacagcatcgcaacgggatctgcagaacctgaactcgatccgtaatgcctcctgcctgcctctttcaagatggaggtgaaacctgtgggagaacctactcaagaggtgtctaaattcaaactttccaccaaggtagaaagcacgggacactggctggtggaagatcatgttcgaatatgggaagttttaaagacagaggagatgggcttcccaacacgatctccttcagcctggaagaggaagaggaactggagggtggagagtcagcagaattcacgtgcttctcagaagatctcgtggcagagcagctgacctacatggatgcacaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgaatgtagactcctgaagaatttttcctccttgagggccatcgtttcggcactgcagtctaattccatctatcggttaaaaaagacttgggctgccgtcccaagggaccgaatgctgatgtttgaagaactttcagatatcttctcagaccataataaccatttgaccagccgagaactactgatgaaggaaggaacctcaaaatttgcaaacctggacagcagtgtgaaagaaaaccagaagcgtacccagaggcggctgcagctccagaaggacatgggtgtgatgcagggaactgtgccctacctgggcaccttcctgactgacctgaccatgcttgacactgcccttcaggactacatcgagggtggactgataaactttgagaaaaggagaagggaatttgaagtgattgcccagataaagctcttacagtctgcctgcaacagctattgcatgaccccagaccaaaagttcatccagtggttccagaggcagcagctcctgacagaggaggagagctatgccctgtcatgtgagattgaagcagctgctgacgccagcaccacctcgcccaagcctcggaagagcatggtgaagagactcagcctactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaaagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttac

SEQ ID NO: 25419 - DNA, 2885 bp, Homo sapiens
taaacccatctcctcctatgccacctgcctgggcccctcctgggactttatcactgtgccacactttttggaactactggttagaaggtgagtgtccatccccctccaagacacagaggtgcctctgtcccctactggctctgtcttgaagatgcacctctcggagcctcggttggctcctctggaacagggagtagtgagaagacgaacctcacagggttcttgtagggactcaatgatctaagacacagcaaacaaaggggtccctagagcctaaaactctggaaaatctgctgggggtgctgtgattcatgtttgttacttttctcttccccctcacttgaagcagctctcagcattctgcctcaatggcctgtatcactcactgtttggaaaaacacatagaaaccaagtctgcgatggcactggtaaaggatgtctgagattccttctggctggtctttctccttgacacagacagaagaggggtcccttggtgctgaaaaaggagccacaggcccactcagacatctggagaggctcactggggttctccaaaggttggggttcactcattcaacacatacattcaaaacacctcatttgtgcatcgctcttcttggggcttggcataatttcataaacaaagcagatgacaatcccccggccttgattctactcagagtcaggcactcacagtagacagaataaacaagtcatatctacagaatgttacaggtgagaccctcatggcctcctctacgtatggtggcatcctcccagattctgactagaatgacgcagcccagcaacaaatataaactgggtggatttagggttctgaagggccttttcacccacaaaacatgggggaaaatatgtggactctggctggggagagactaaaggagctctggggctcatacttcttataattcccacgagaaggctgacatctggggacttcccccacaagaggcaaatagtgagttctgtaaatggagacttaggtcccctgcaaagcagaggggaggctggggtcacagctggccactgagagacccatccccctcagcaccgtggcttcccagctctccctgtcctcctccccccgacatctgccccttccctcctaaccccaggaccaggggacccagatctggagctttgatgaggaagctgctcacaaatctgcctgcagctgcagtcttgagtgcccaggtgtacagtgctgtgctccagggcctttgggaagagaatgtctgtgggacgccagggcgcacgagggtctgtacagccctgctgtatggccaggtctgccccttccaggacagcactgatggcttacgcaccatcacctccattttgttcaactggccccccgaaaacacttcagtttactatcagcccccgcaacggtcatctttccggataaagctggccttcaggaacctctcctggcctggactgggcttggaggaccatcaggaaattgtcctaggccagttggtgcttccggagcccaacgaggccaagccagatgatcctgctccacgtcctgggcaacacgcattaacaatgccggccctggagccagcaccaccactgctggcggacctggggcctgctctggagccagagtcacctgcagccctgggtccaccaggatatctacattcagcaccagggccagcaccagcaccaggggaagggccccctccagggacagtgctggagccacagtcagccccagagtcctcctgtccctgtcgtgggtctgtaaagaaccaacccagtgaggagctgcctgacatgacgaccttccctcccaggctgctggcagagcagctgaccctcatggatgcggagctgttcaagaaggtggtgctccacgaatgcttgggctgcatctggggccaaggacatctgaaggggaatgagcacatggcacccacagttcgtgccaccatcgcacacttcaacaggctcaccaactgcatcaccacctcctgcctcggggaccacagcatgagggcccgggacagggccagggtggtggagcactggatcaaggtggccagggagtgcctaagcctcaacaacttctcctcggtgcacgtcatcgtctctgctctgtgcagcaacccaataggtcagctacacaagacgtgggcaggagtgtccagcaaaagcatgaaagagctaaaagaactctgcaaaaaagacactgcagtgaagagggacctactgatcaaggcggggagctttaaggtggccacccaggagaggaacccccagagagtccagatgaggctgcggaggcagaagaagggtgtggtccccttcctgggggattttctgactgagttacagaggctggattcggccatcccggacgacctggatggcaacaccaacaagaggagcaaggaggtccgagttctgcaggaaatgcagctgctccaagtggctgccatgaattacaggcttcggcctcttgagaaatttgtcacctatttcacaagaatggagcagctcagtgacaaagagagctacaagctgtcctgccagctggagcccgaaaacccgtaggctggcaacatcctgcagtggctgggaacccaccgggatgctggccagaacaccggctctgcaccatccctcacccagaccgtagacaccagggaaccacatctaggaggctggcagctcagctgcatcttgccctggatcctcatcaccaactgctcctgctggccaggatcaggccatgggacttttgtgagtcaggcgggagaccattttatgtttattttctttagtgtataagtaagggttttttcttaactttcgttaaaataaaattttaaaaaactattcaaaat

SEQ ID NO: 25420 - DNA, 2959 bp, Homo sapiens
taaacccatctcctcctatgccacctgcctgggcccctcctgggactttatcactgtgccacactttttggaactactggttagaaggtgagtgtccatccccctccaagacacagaggtgcctctgtcccctactggctctgtcttgaagatgcacctctcggagcctcggttggctcctctggaacagggagtagtgagaagacgaacctcacagggttcttgtagggactcaatgatctaagacacagcaaacaaaggggtccctagagcctaaaactctggaaaatctgctgggggtgctgtgattcatgtttgttacttttctcttccccctcacttgaagcagctctcagcattctgcctcaatggcctgtatcactcactgtttggaaaaacacatagaaaccaagtctgcgatggcactggtaaaggatgtctgagattccttctggctggtctttctccttgacacagacagaagaggggtcccttggtgctgaaaaaggagccacaggcccactcagacatctggagaggctcactggggttctccaaaggttggggttcactcattcaacacatacattcaaaacacctcatttgtgcatcgctcttcttggggcttggcataatttcataaacaaagcagatgacaatcccccggccttgattctactcagagtcaggcactcacagtagacagaataaacaagtcatatctacagaatgttacaggtgagaccctcatggcctcctctacgtatggtggcatcctcccagattctgactagaatgacgcagcccagcaacaaatataaactgggtggatttagggttctgaagggccttttcacccacaaaacatgggggaaaatatgtggactctggctggggagagactaaaggagctctggggctcatacttcttataattcccacgagaaggctgacatctggggacttcccccacaagaggcaaatagtgagttctgtaaatggagacttaggtcccctgcaaagcagaggggaggctggggtcacagctggccactgagagacccatccccctcagcaccgtggcttcccagctctccctgtcctcctccccccgacatctgccccttccctcctaaccccaggaccaggggacccagatctggagctttgatgaggaagctgctcacaaatctgcctgcagctgcagtcttgagtgcccaggtgtacagtgctgtgctccagggcctttgggaagagaatgtctgtgggacgccagggcgcacgagggtctgtacagccctgctgtatggccaggtctgccccttccaggacagcactgatggcttacgcaccatcacctccattttgttcaactggccccccgaaaacacttcagtttactatcagcccccgcaacggtcatctttccggataaagctggccttcaggaacctctcctggcctggactgggcttggaggaccatcaggaaattgtcctaggccagttggtgcttccggagcccaacgaggccaagccagatgatcctgctccacgtcctgggcaacacgcattaacaatgccggccctggagccagcaccaccactgctggcggacctggggcctgctctggagccagagtcacctgcagccctgggtccaccaggatatctacattcagcaccagggccagcaccagcaccaggggaagggccccctccagggacagtgctggagccacagtcagccccagagtcctcctgtccctgtcgtgggtctgtaaagaaccaacccagtgaggagctgcctgacatgacgaccttccctcccaggctgctggcagagcagctgaccctcatggatgcggagctgttcaagaaggtggtgctccacgaatgcttgggctgcatctggggccaaggacatctgaaggggaatgagcacatggcacccacagttcgtgccaccatcgcacacttcaacaggctcaccaactgcatcaccacctcctgcctcggggaccacagcatgagggcccgggacagggccagggtggtggagcactggatcaaggtggccagggagtgcctaagcctcaacaacttctcctcggtgcacgtcatcgtctctgctctgtgcagcaacccaataggtcagctacacaagacgtgggcaggagtgtccagcaaaagcatgaaagagctaaaagaactctgcaaaaaagacactgcagtgaagagggacctactgatcaaggcggggagctttaaggtggccacccaggagaggaacccccagagagtccagatgaggctgcggaggcagaagaagggtgtggtccccttcctgggggattttctgactgagttacagaggctggattcggccatcccggacgacctggatggcaacaccaacaagaggagcaaggaggtccgagttctgcaggaaatgcagctgctccaagtggctgccatgaattacaggcttcggcctcttgagaaatttgtcacctatttcacaagaatggagcagctcagtgacaaagagagatggggtttcacgatgatgtccaggatcgtctcaaactcctggcctcaagcaatccacccacctcagcctcccaaagtactgacgttacagctacaagctgtcctgccagctggagcccgaaaacccgtaggctggcaacatcctgcagtggctgggaacccaccgggatgctggccagaacaccggctctgcaccatccctcacccagaccgtagacaccagggaaccacatctaggaggctggcagctcagctgcatcttgccctggatcctcatcaccaactgctcctgctggccaggatcaggccatgggacttttgtgagtcaggcgggagaccattttatgtttattttctttagtgtataagtaagggttttttcttaactttcgttaaaataaaatttt

SEQ ID NO: 25421 - DNA, 4368 bp, Homo sapiens
agtctggtttaactggttggaacgactaaagcacgctggcgcaaggaaagctctcaacttcgggagctgaggcgcaggctggccagagcgtggagaggaaagccctttccatcctcaaggccgttgcaggagatgcccgcgagccaccttcgccagcaccacaccggggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttataaatattctccttgctcaggagaatgagatcctgactgaacaggaggagctcctggccatggagcagtttctgcgccggcagattgcctcagaaaaagaagagattgaacgcctcagagctgagattgctgaaattcagagtcgccagcagcacggccgaagtgagactgaggagtactcctccgagagcgagagcgagagtgaggatgaggaggagctgcagatcattctggaagacttacagagacagaacgaagagctggaaataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccaccccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagacaaa

SEQ ID NO: 25422 - DNA, 4353 bp, Homo sapiens
atcattgtaaacaggcagaggctgggcggggtgggaatggggcgcccgaggccggcctggggcgcagcgcaggaggcggctccggtggctgcggcggcagcgtgagcgcgaggaggcggaggctgcggcggggcggacggtcgcgcggcggcaggcacaggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttataaatattctccttgctcaggagaatgagatcctgactgaacaggaggagctcctggccatggagcagtttctgcgccggcagattgcctcagaaaaagaagagattgaacgcctcagagctgagattgctgaaattcagagtcgccagcagcacggccgaagtgagactgaggagtactcctccgagagcgagagcgagagtgaggatgaggaggagctgcagatcattctggaagacttacagagacagaacgaagagctggaaataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccaccccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagctt

SEQ ID NO: 25423 - DNA, 1309 bp, Homo sapiens
tgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattca

SEQ ID NO: 25424 - DNA, 7771 bp, Homo sapiens
atggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccagatcacagaactgtgtggtgcaaagcgggttggttattttggtccaacacagttttacattgccctgaaattaattgctgcagcacaatctggcctcccggtacggatagagagtattaaatgtgaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacaggaaacacagtctcccacgatgtcacccctcgcctcccctccttcttccccgcctcattaccagagggtgcccttgagccatggctacagcaaactgcggagcagcgcagaacagatgcatccagcaccttatgaagctaggcagccccttgtccagcccgagggatcctcatcagggggcccaggaaccaagccccttcggcatcaggcttcccttatccggtccttttcagtggagagggaactacaggataacagcagttaccccgacgaaccctggaggataacagaagaacagcgcgagtactatgtcaatcagttccgatcccttcagccagacccaagctctttcatttcaggttctgtggccaagaacttcttcaccaaatcaaagctttccattccagaactctcctatatatgggagcttagtgatgctgactgtgatggagccctgaccctgcctgagttctgtgctgcgtttcatctcattgtggctcggaagaacggctacccattgcctgagggcctccctccaactctgcagccagaatacctgcaggcagcttttcctaagcccaaatgggactgtcaattatttgattcttattctgagtcactgccggcaaatcaacaacctcgtgacttgaatcggatggagaagacatctgttaaagacatggctgaccttcctgtccctaaccaggatgtaactagtgatgacaaacaagctttgaaaagtactatcaatgaagccttaccaaaggacgtgtctgaggatccagcaactcccaaggattccaacagtctcaaagcaagaccaagatccagatcttactctagcacctccatagaagaggccatgaaaaggggcgaggaccctcccaccccgccacctcggccacagaaaacccattccagagcctcctccttggatctgaataaagtcttccagcccagtgtgccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccatatgaccttttctcttgcacttcacttgtatgttttactgtggtggaaaaaatacttcaactgattatcacacttgaaatgctaattatcagtggaatttgtctcctattcttaagtacttctgcaaggtattagatgctgctccttaccaaaaatcagtcttctagcaaataaaaataacttagagcattatttatttaaagaatttatgttttctataaaaccttataaccaagaaccttcaggatgcttgtaaccaagtactttcaggatgctttttgtatgtatatcacatagagtaggttggtttcctgagtaattgggattccaactagatagtcattggtgtgaccataataaaaacaaaagctaaaataaaagcatcagatttagactggcgctgtgccctctaccactatatgccaaaaattgcttctctagtgccattttgatattatatctagctataaataatacatgactatcgttttctattgaatgtcaaagacttactgggtctttacacctctgtaaagtggaggttttggcaatgagctgtttaacttggccaagctaggctgtcaacccagacaactcagtcctttcatgtaaatttttgggcaagagaagtctgctttgactgccttgcctgaccaaattaaataaatagttgccagatctctacttttatcctgcatgggataatatatctgtaaatgcatgagtttggaaaccacccatcaaatatgaaaggctgatgagactgttaggattgataaacatttgttgtttgaacccagctatccaaactggggaagaaggggaaatggttgttaccaacaatctctagtagttattttaatctttattttaacctggattgcaaatgtatggggtatgaggagataatgaaagaaaagtggtcctcatgctggatatgtgactgttttgttctctgtaaagtgtattcttgggaagtgattggtttatatcagattcagaggagcccaattaactccagtgtaggtaatgtaaaacagtaagctcaaattgcagaagccagtatcctacagaaatttaagtagctactgcttctcctgaaagcccaagttgaaaatgggaccacaggggcacagggctactgaccctcacagggcatgccagcgttaacaccactttgagagaccaatggcaagaaatgctgtctcttgtgcattttactaatttccccattcttagggtagcagggtgggggtgtatagggtctttttgaagcagttttggataggtttgcaatatgtgggattcagcctttgatttcaatagagctgagagcttttagaacaagcaggcatttatttaatgtttccttagtccattggcaagctttatcaatagcttaatggcagaggataaaggctcaaacagatgatgttttttccacagaaaaacaaattgttgaatctattccgtgcatatttaaggattttgaattgattttgaaaatcatgaaacttgaactatttttctattccctttttttcttccccatttgctgccttttttgtttttgtgggggaagggttgggagtaagtttaaactcttccgaagattatgaatgggtcagcacaaatttttaggcaactgctttttccatgttctgagatctacgggctacaacaaattttatcagcagtgttttttgtttttttgagatggagacttgctctgtcgcccaggctggagcgcagtggcgcaatctcggctcactgcaacctccacctcctgggttcaagcaattcttgtgcctcagcctcccgagtagctgggattacaggcacccaccaccacgctcagctaatttttgtatttttagtagagatgggattttgtcatgttggctaggctagtctcgaattcctgacctcaagtgatccacccgccttggcctctcgaagtgctgggattacaggcgtgagccacccgcccggctatcagcactgttctgattgcagacgtttcacagcatgtttggcttttggtaaattcaatccaggaaagactagcatgtgcactttatctcataatcttccagtacatatgctctcagttgggatagcagttcatttccattaggcagacgtataaactaaggaatgttagtctgcagtattcattttaaaaatattgacatgcttttcccctcccctccatgaagtcagtgccagagtgagccagattgggaggttggggttttgtttggttggcttggttttcattaagggaaaaaacttgcattggacaatcaaattcccctgagtttcataatctcatcaatattttaagataggcgagcacacactaataatatctatgcctaccttcttgggtggactcaactgtaaccacagtttattagttgcttagaagtggatttttaaaaaacagttaaatgtgtgtgcataacacacaagtaatgacacactactattattattacctaagtagtgctcatcctctctttctgtgttttcttaggatgtgcactttaatttaggattgtaacgcctaataatatttctgtgagcctttaatgtgatttataagatggccgaattactgaaatcaccattatacctcttccataaaacgactccaaagttagacctgcctgttggggagaattctatagacagaaggtcaatgttgtccccatccataggggttgaattaccttgctgttaagtggtcttcccccattgggatcctacagtcccacagatgaaagcacagtagtagctgacagctggcttatttggtccctcggcatctctcgtatgtggcatattgcttttgccactttcctatccagcagacatcaaagcaaaactaaaaggtagatatctggaatgaatgtatatgttgtaattgaggcagatatttgccttaattggaaggatctaactgctttacaaatattaaacaagtgcttgggcatgattgggagaggaggcagcttagctggaagctgtgcccatcttactgtcactggagaataggatgtcagagctgggcaggactggtacccatcatttgcagtttgcatgtggggaaaccaaagccctaagaaacaacagttcctggcccaaaaaatccatagaaagaggtaactagtggcagatttggggcgccaacctgattttatggattttgagttagattctctaccctctatcaatactaaaaatagattaggagggtttttttttctgtttatcatgttgaatttcattgacttaattagtctttaaatttgaaaacatgttttagggagtttagttctagaaatttctcttagattgaagtgacagaatctgaaagaaaagaatatgattgagctatttgttttcctgaacacctcaccttttatgatgcaataagttactctgagtttcttggcagagtttttgacagctgttgctttcaatggattccattcctgtattccttatgggaggttgtttttaaaatagactactgcgattgaaatgaactcaatatgtagttaagttatagttttcttcaatgtatttttagttacttgggtcacaaatgttcaatttcagcatattttagggtgagtaatcaaaaatgtgaatttgcctttgatttcctaccactgtctgagctatcataaagcattctctttagttgtgatttgattctatagtctgtttctaaatgacatttgtctgtttcttaaatgatctcacagccatggtaataatagatgtgtactcagaagatcaataaggtaatattggaattcatgtgttttttgcaattaaggcaggcatttgccaatgtcttcttttaagcagtagttggaaacatctcaattacagtgtaacaccttagagctaaaaacatttgttcaacacaaactagaatcacaccttctcactagatatcaccaagggaatgtggttttaaaaataaaaagaaaacaatataacgtatcatggcaaccagagcttcccatattattgacaagtagggatcattaggttctggtttgaacattctgaatgtgaacaaaatgaaatagtagttaagaggtgttttcccactgtgtttaaagagaacactagtaattctggtttttctttctaactgctttactgtttcaagggtattcttttaaaactctgatttcaaaggatcagttgaatttatactttagttatgggtgttttgttactttttttttttttgtatcatgactcagtatggttcaatttcctagtaagaagtggggatttgtgtttttggagtcctcagctcacatgtcttgttcctccttcagcacaagctaggggagatcctaccaacactgataggtcagtcattgatggcaatttgaatgtgggtattactctgtgagccaccctgcttcgcttgtttgtaaggagaaatgcatctggttatgtgaatttcccgagagcagcagacatggagggccagactttaaaagcaacgcaagcagattcgaagagctgttgccctcttctaaaaaaggcttttggaggctgtgttacatgcatgccctaaagcagtcagtctgttagtatgagcaagacatctgaagtacacagttgcttttaggcttgtatagttattttctacacatgccaacacacatgatgataaaggaaccttttctaggaggcattgcagggtttcaatacacaggacatgttctagttacagaagccttgctctgctgtcaacaattgggaaatgctcattttttcatgttttgtgaatactctggtcttgctgtaagctaatgtcatggctgtgggatattagagaagtgggtttatgactctgaagaccagcagacaccagactttaaaagtgcttaaattggaatttggaaactacagtaaagaaaccttcagataccagttccatcctgaagccctctgttgaacaacagggccagatcctaaagctctttcagggagctcttctctggggctggaacagttgattatgcaaccccattgtgtggagattggatcaactgagttgtgttatttttgttttaagtcaccttgtgcgagaacctcaaccgcacctatcttgggaaccgggtatacccttttctttagcactgctatcctttttgtcttcagcacaaataagatgttcaagtgagccagaagcaagaagagccattttagtcttcatagctattggctaagagagataatgagctgatggtctattttaaccttgaaagtaaaaatgtatattttttcactacaagtacattgaacagtaaaaagtgtaacagcaaagtatatatttgatgccttctgtcttttcatgataatgtgctaacaagttgtgttaatattttactcagccagagtctcattcatttgctaagcattgggaacattatgtatattgaccttaaacataggtgtcctatatttggattgtgacttgtagactcaagctaaccttactgcctctttttcacacttgttgaaaagtctgtgaagaacatagttaaagatctccaactttggaaaatatacatgatgtgaaactggggtgctatgttaaaaataaatgtatgataactaa

SEQ ID NO: 25425 - DNA, 7945 bp, Homo sapiens
ccgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggacagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccagatcacagaactgtgtggtgcaaagcgggttggttattttggtccaacacagttttacattgccctgaaattaattgctgcagcacaatctggcctcccggtacggatagagagtattaaatgtgaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacagcaggaaacacagtctcccacgatgtcacccctcgcctcccctccttcttccccgcctcattaccagagggtgcccttgagccatggctacagcaaactgcggagcagcgcagaacagatgcatccagcaccttatgaagctaggcagccccttgtccagcccgagggatcctcatcagggggcccaggaaccaagccccttcggcatcaggcttcccttatccggtccttttcagtggagagggaactacaggataacagcagttaccccgacgaaccctggaggataacagaagaacagcgcgagtactatgtcaatcagttccgatcccttcagccagacccaagctctttcatttcaggttctgtggccaagaacttcttcaccaaatcaaagctttccattccagaactctcctatatatgggagcttagtgatgctgactgtgatggagccctgaccctgcctgagttctgtgctgcgtttcatctcattgtggctcggaagaacggctacccattgcctgagggcctccctccaactctgcagccagaatacctgcaggcagcttttcctaagcccaaatgggactgtcaattatttgattcttattctgagtcactgccggcaaatcaacaacctcgtgacttgaatcggatggagaagacatctgttaaagacatggctgaccttcctgtccctaaccaggatgtaactagtgatgacaaacaagctttgaaaagtactatcaatgaagccttaccaaaggacgtgtctgaggatccagcaactcccaaggattccaacagtctcaaagcaagaccaagatccagatcttactctagcacctccatagaagaggccatgaaaaggggcgaggaccctcccaccccgccacctcggccacagaaaacccattccagagcctcctccttggatctgaataaagtcttccagcccagtgtgccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccatatgaccttttctcttgcacttcacttgtatgttttactgtggtggaaaaaatacttcaactgattatcacacttgaaatgctaattatcagtggaatttgtctcctattcttaagtacttctgcaaggtattagatgctgctccttaccaaaaatcagtcttctagcaaataaaaataacttagagcattatttatttaaagaatttatgttttctataaaaccttataaccaagaaccttcaggatgcttgtaaccaagtactttcaggatgctttttgtatgtatatcacatagagtaggttggtttcctgagtaattgggattccaactagatagtcattggtgtgaccataataaaaacaaaagctaaaataaaagcatcagatttagactggcgctgtgccctctaccactatatgccaaaaattgcttctctagtgccattttgatattatatctagctataaataatacatgactatcgttttctattgaatgtcaaagacttactgggtctttacacctctgtaaagtggaggttttggcaatgagctgtttaacttggccaagctaggctgtcaacccagacaactcagtcctttcatgtaaatttttgggcaagagaagtctgctttgactgccttgcctgaccaaattaaataaatagttgccagatctctacttttatcctgcatgggataatatatctgtaaatgcatgagtttggaaaccacccatcaaatatgaaaggctgatgagactgttaggattgataaacatttgttgtttgaacccagctatccaaactggggaagaaggggaaatggttgttaccaacaatctctagtagttattttaatctttattttaacctggattgcaaatgtatggggtatgaggagataatgaaagaaaagtggtcctcatgctggatatgtgactgttttgttctctgtaaagtgtattcttgggaagtgattggtttatatcagattcagaggagcccaattaactccagtgtaggtaatgtaaaacagtaagctcaaattgcagaagccagtatcctacagaaatttaagtagctactgcttctcctgaaagcccaagttgaaaatgggaccacaggggcacagggctactgaccctcacagggcatgccagcgttaacaccactttgagagaccaatggcaagaaatgctgtctcttgtgcattttactaatttccccattcttagggtagcagggtgggggtgtatagggtctttttgaagcagttttggataggtttgcaatatgtgggattcagcctttgatttcaatagagctgagagcttttagaacaagcaggcatttatttaatgtttccttagtccattggcaagctttatcaatagcttaatggcagaggataaaggctcaaacagatgatgttttttccacagaaaaacaaattgttgaatctattccgtgcatatttaaggattttgaattgattttgaaaatcatgaaacttgaactatttttctattccctttttttcttccccatttgctgccttttttgtttttgtgggggaagggttgggagtaagtttaaactcttccgaagattatgaatgggtcagcacaaatttttaggcaactgctttttccatgttctgagatctacgggctacaacaaattttatcagcagtgttttttgtttttttgagatggagacttgctctgtcgcccaggctggagcgcagtggcgcaatctcggctcactgcaacctccacctcctgggttcaagcaattcttgtgcctcagcctcccgagtagctgggattacaggcacccaccaccacgctcagctaatttttgtatttttagtagagatgggattttgtcatgttggctaggctagtctcgaattcctgacctcaagtgatccacccgccttggcctctcgaagtgctgggattacaggcgtgagccacccgcccggctatcagcactgttctgattgcagacgtttcacagcatgtttggcttttggtaaattcaatccaggaaagactagcatgtgcactttatctcataatcttccagtacatatgctctcagttgggatagcagttcatttccattaggcagacgtataaactaaggaatgttagtctgcagtattcattttaaaaatattgacatgcttttcccctcccctccatgaagtcagtgccagagtgagccagattgggaggttggggttttgtttggttggcttggttttcattaagggaaaaaacttgcattggacaatcaaattcccctgagtttcataatctcatcaatattttaagataggcgagcacacactaataatatctatgcctaccttcttgggtggactcaactgtaaccacagtttattagttgcttagaagtggatttttaaaaaacagttaaatgtgtgtgcataacacacaagtaatgacacactactattattattacctaagtagtgctcatcctctctttctgtgttttcttaggatgtgcactttaatttaggattgtaacgcctaataatatttctgtgagcctttaatgtgatttataagatggccgaattactgaaatcaccattatacctcttccataaaacgactccaaagttagacctgcctgttggggagaattctatagacagaaggtcaatgttgtccccatccataggggttgaattaccttgctgttaagtggtcttcccccattgggatcctacagtcccacagatgaaagcacagtagtagctgacagctggcttatttggtccctcggcatctctcgtatgtggcatattgcttttgccactttcctatccagcagacatcaaagcaaaactaaaaggtagatatctggaatgaatgtatatgttgtaattgaggcagatatttgccttaattggaaggatctaactgctttacaaatattaaacaagtgcttgggcatgattgggagaggaggcagcttagctggaagctgtgcccatcttactgtcactggagaataggatgtcagagctgggcaggactggtacccatcatttgcagtttgcatgtggggaaaccaaagccctaagaaacaacagttcctggcccaaaaaatccatagaaagaggtaactagtggcagatttggggcgccaacctgattttatggattttgagttagattctctaccctctatcaatactaaaaatagattaggagggtttttttttctgtttatcatgttgaatttcattgacttaattagtctttaaatttgaaaacatgttttagggagtttagttctagaaatttctcttagattgaagtgacagaatctgaaagaaaagaatatgattgagctatttgttttcctgaacacctcaccttttatgatgcaataagttactctgagtttcttggcagagtttttgacagctgttgctttcaatggattccattcctgtattccttatgggaggttgtttttaaaatagactactgcgattgaaatgaactcaatatgtagttaagttatagttttcttcaatgtatttttagttacttgggtcacaaatgttcaatttcagcatattttagggtgagtaatcaaaaatgtgaatttgcctttgatttcctaccactgtctgagctatcataaagcattctctttagttgtgatttgattctatagtctgtttctaaatgacatttgtctgtttcttaaatgatctcacagccatggtaataatagatgtgtactcagaagatcaataaggtaatattggaattcatgtgttttttgcaattaaggcaggcatttgccaatgtcttcttttaagcagtagttggaaacatctcaattacagtgtaacaccttagagctaaaaacatttgttcaacacaaactagaatcacaccttctcactagatatcaccaagggaatgtggttttaaaaataaaaagaaaacaatataacgtatcatggcaaccagagcttcccatattattgacaagtagggatcattaggttctggtttgaacattctgaatgtgaacaaaatgaaatagtagttaagaggtgttttcccactgtgtttaaagagaacactagtaattctggtttttctttctaactgctttactgtttcaagggtattcttttaaaactctgatttcaaaggatcagttgaatttatactttagttatgggtgttttgttactttttttttttttgtatcatgactcagtatggttcaatttcctagtaagaagtggggatttgtgtttttggagtcctcagctcacatgtcttgttcctccttcagcacaagctaggggagatcctaccaacactgataggtcagtcattgatggcaatttgaatgtgggtattactctgtgagccaccctgcttcgcttgtttgtaaggagaaatgcatctggttatgtgaatttcccgagagcagcagacatggagggccagactttaaaagcaacgcaagcagattcgaagagctgttgccctcttctaaaaaaggcttttggaggctgtgttacatgcatgccctaaagcagtcagtctgttagtatgagcaagacatctgaagtacacagttgcttttaggcttgtatagttattttctacacatgccaacacacatgatgataaaggaaccttttctaggaggcattgcagggtttcaatacacaggacatgttctagttacagaagccttgctctgctgtcaacaattgggaaatgctcattttttcatgttttgtgaatactctggtcttgctgtaagctaatgtcatggctgtgggatattagagaagtgggtttatgactctgaagaccagcagacaccagactttaaaagtgcttaaattggaatttggaaactacagtaaagaaaccttcagataccagttccatcctgaagccctctgttgaacaacagggccagatcctaaagctctttcagggagctcttctctggggctggaacagttgattatgcaaccccattgtgtggagattggatcaactgagttgtgttatttttgttttaagtcaccttgtgcgagaacctcaaccgcacctatcttgggaaccgggtatacccttttctttagcactgctatcctttttgtcttcagcacaaataagatgttcaagtgagccagaagcaagaagagccattttagtcttcatagctattggctaagagagataatgagctgatggtctattttaaccttgaaagtaaaaatgtatattttttcactacaagtacattgaacagtaaaaagtgtaacagcaaagtatatatttgatgccttctgtcttttcatgataatgtgctaacaagttgtgttaatattttactcagccagagtctcattcatttgctaagcattgggaacattatgtatattgaccttaaacataggtgtcctatatttggattgtgacttgtagactcaagctaaccttactgcctctttttcacacttgttgaaaagtctgtgaagaacatagttaaagatctccaactttggaaaatatacatgatgtgaaactggggtgctatgttaaaaataaatgtatgataactaa

SEQ ID NO: 25426 - DNA, 1995 bp, Homo sapiens
ccgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggacagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccagatcacagaactgtgtggtgcaaagcgggttggttattttggtccaacacagttttacattgccctgaaattaattgctgcagcacaatctggcctcccggtacggatagagagtattaaatgtgaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacagcaggaaacacagtctcccacgatgtcacccctcgcctcccctccttcttccccgcctcattaccagagggtgcccttgagccatggctacagcaaactgcggagcagcgcagaacagatgcatccagcaccttatgaagctaggcagccccttgtccagcccgagggatcctcatcagggggcccaggaaccaagccccttcggcatcaggcttcccttatccggtccttttcagtggagagggaactacaggataacagcagttaccccgacgaaccctggaggataacagaagaacagcgcgagtactatgtcaatcagttccgatcccttcagccagacccaagctctttcatttcaggttctgtggccaagaacttcttcaccaaatcaaagctttccattccagaactctcctatatatgggagcttagtgatgctgactgtgatggagccctgaccctgcctgagttctgtgctgcgtttcatctcattgtggctcggaagaacggctacccattgcctgagggcctccctccaactctgcagccagaatacctgcaggcagcttttcctaagcccaaatgggactgtcaattatttgattcttattctgagtcactgccggcaaatcaacaacctcgtgacttgaatcggatggagaagacatctgttaaagacatggctgaccttcctgtccctaaccaggatgtaactagtgatgacaaacaagctttgaaaagtactatcaatgaagccttaccaaaggacgtgtctgaggatccagcaactcccaaggattccaacagtctcaaagcaagaccaagatccagatcttactctagcacctccatagaagaggccatgaaaaggggcgaggaccctcccaccccgccacctcggccacagaaaacccattccagagcctcctccttggatctgaataaagtcttccagcccagtgtgccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagtatgtgggattcagcctttgatttcaatagagctgagagcttttagaacaagcaggcatttatttaatgtttccttagtccattggcaagctttatcaatagcttaa

SEQ ID NO: 25427 - DNA, 1723 bp, Homo sapiens
aggatgctctgagctctaaaaggaggagcagttttgctggcatgcagaagtggtgaagatcacagaactgtgtggtgcaaagcgggttggttattttggtccaacacagttttacattgccctgaaattaattgctgcagcacaatctggcctcccggtacggatagagagtattaaatgtgaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacaggaaacacagtctcccacgatgtcacccctcgcctcccctccttcttccccgcctcattaccagagggtgcccttgagccatggctacagcaaactgcggagcagcgcagaacagatgcatccagcaccttatgaagctaggcagccccttgtccagcccgagggatcctcatcagggggcccaggaaccaagccccttcggcatcaggcttcccttatccggtccttttcagtggagagggaactacaggataacagcagttaccccgacgaaccctggaggataacagaagaacagcgcgagtactatgtcaatcagttccgatcccttcagccagacccaagctctttcatttcaggttctgtggccaagaacttcttcaccaaatcaaagctttccattccagaactctcctatatatgggagcttagtgatgctgactgtgatggagccctgaccctgcctgagttctgtgctgcgtttcatctcattgtggctcggaagaacggctacccattgcctgagggcctccctccaactctgcagccagaatacctgcaggcagcttttcctaagcccaaatgggactgtcaattatttgattcttattctgagtcactgccggcaaatcaacaacctcgtgacttgaatcggatggagaagacatctgttaaagacatggctgaccttcctgtccctaaccaggatgtaactagtgatgacaaacaagctttgaaaagtactatcaatgaagccttaccaaaggacgtgtctgaggatccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccatatgaccttttc

SEQ ID NO: 25428 - DNA, 5305 bp, Homo sapiens
ggactcggactcggtttccctgcggcccagggaggctcacgggccattggctgagcggggcggatctggtcccgctcctccccgcccccagtgacacaatagtagctccctccaagatggcggcagcgacggcagacccgggagctgggaacccgcagcctggggactcctccggcgggggcgctgggggcgggctgccgtcccctggggagcaggagctgagccggcgcttgcagcgcctgtatcccgcggtcaaccagcaagagactccgctgccgcgctcctggagccccaaggacaaatacaactacattggtctctcccagggcaacctccgcgtccactacaaaggtcatggcaaaaatcacaaagatgcggcctcagtgcgtgccacccaccccatacctgctgcctgtggcatttattactttgaagtgaagattgtcagcaaaggaagagatggttacatgggaataggactctcggctcaaggcgtcaacatgaacagacttcctggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagttggtgatagcttattattttcataagtaaaaaacaaatgagattatatatatatatataaaaatatatatattaaaaaaaaagacagtatttatcgtagcattagtggtccagcacctcttgggtgaggctgtccaggcaccatgttttctttgagtccaactcattaaaaaagaagaatctctgtcacctcagccaagtgatttattttttgctcccccttttttgagtcacaggccgagctgcagcctaggaaacccaaatagggtttggtgggccacttagtgggcatggttacattggtttatagcatcccaagaactgtagatccctaggcccctgagagctggacagagcagagaactacagggccaagggtccagagaagtgataacttggcccagggccacacagcagaggtagagggtccttggccagcacactatctaccactctaccccacctcccactgcctgccttgctcccctttcctcccttttcaataccctatcttcccttgttgttaagatggccaaataatacatttactctaaattgattgcctggaaactacctgccttcgtcctgagagcttctgtgtgtcaggctgctggaaagaagactccattcccaggacagaggcccttgagtacaggggctgctttcttcctgcctagatcttcaccatctctgcacagctctgagagaatggatgctttctgttgagaaaccagtaccttgtggaggcaggttcttgggctgctactccagggagtggatggaatccttggtcccctaggccagacttcactgccactgtgccagacagctccctgcagctgggccctagccactcttaggaaagactattgggagtatttgctggccagagaatgggactctatcagctttacacatgtcccaccagctgtttcagatagatccttacagctggcagagtaaaagtggtcccgctaccattggggaatcaggaaaggaaagactgagatggttgccaggacttggggtggcccacctgtggagaggactggctgccctggaggaggaaagggaggaagtctacacagaggagcaccaggacggctggaatttccatatgtgcttcacattgtgaggggagtgcacaagccgcccatgcaaagagtagggtcagccatggcaaggccggaagttgaactttcagtccctgcctgaatctgggctttgcaagctcctgctccatattggtggacatgggaatggttggtgtggcctgagatacccattgctcaccaggcctcactgggcccacagctgggcaacaagaaaaatgtttgaattggaccaactgctggtgatggggccagggccctgggccctgtgctgtcagaattctgccttgggaaatgatcctatagctgctgctttttcttggtccttggggctggcagacccatagaccatggcctgttaggaggcgtcctgtctgtaaaggaaattcatctcttgtgacagcctggggctacctagctcccaaacccagaagttggagacatcaggctgtttaaatgatcatagcctagcaggattggattaaaaccacaggcttttgcagctggaatggggttcagtgaacatctcccccattcctctcttgctacaaataaggaaacaggcccaggagattaagtgacttggctaaagtcacatagcaaattagtagcagagccgggactatcccttatccctgtgggttgggcaacactatttagtcctgaaaccgaatggcagataaaccccatgaggggtcaggctgatgtgccctccagcagtatctgagaagctgctaccttcaggggtgtgtcagggatgaggacgggtgcctgagcttaggttgtggagtggctgagagggcccaggagggctcgggacagctgtgtgctgcatggggttgggtgtctgcctggctcgcacttggtacccatggccacctccccattttctgtgccttatctcactgtttcagctgagtccaagttgtttactctgttcctctccagaggggctctctgtcccagttgggcagctcacctttgggacataagcctttgccccacaagctgtggagagggccaaaaccaagctgcttgagcccactctcttgctgagagtccaggcctgcctgcctgccagccagaggtgccccttatgcacatccagtcctaccagcctgcttccaggagcctagagtgggaaaggcacctgggggagccctggtgaagggctggacctgacccatggaggcaggaggaagacctggctttcttggtttgtccggccctggggagcagccttccctactcactttccccttgcggcaccaaatggtcactccttccagagcaaaaactggcactcatagcaagccagaacccccatccccatcctcatgggtctgtggctgggtgcaggccatcaaaatggacaccacgagacagaagtggggactgcctggccacctagcgccttcccactccttaagcaagcacaaagaagatgaggcagagaattgtcagagctgaaagttcctttggttgctcacaactcaggtatgcacccatgtggcagccaggcagcggagccctactagactgccagtctcatgcacccagacctgtggccagattgtggcctctggctgcctcaggcattttcctctttgcattgggttttcctgcattagtaactacagctgcaacagacatcctccacattgtgcacactggttttgcctttgtcctcaagagttgatacttggcattagcatgaaacttgtgggtgtgggaggatggagagagaactctaacacaaaacatcttattaaaattgtacttgagagacaaaaaaaaaactctgttgtattttgacaga

SEQ ID NO: 25429 - DNA, 2262 bp, Homo sapiens
gacacaatagtagctccctccaagatggcggcagcgacggcagacccgggagctgggaacccgcagcctggggactcctccggcgggggcgctgggggcgggctgccgtcccctggggagcaggagctgagccggcgcttgcagcgcctgtatcccgcggtcaaccagcaagagactccgctgccgcgctcctggagccccaaggacaaatacaactacattggtctctcccagggcaacctccgcgtccactacaaagttacatgggaataggactctcggctcaaggcgtcaacatgaacagacttcctggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcaacccatggctacagcttgaaaggaggcccaaccaggctgctccaaccacaccccctgggccaactcccacctcaacccctccccacagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagtt

SEQ ID NO: 25430 - DNA, 1248 bp, Homo sapiens
gacacaatagtagctccctccaagatggcggcagcgacggcagacccgggagctgggaacccgcagcctggggactcctccggcgggggcgctgggggcgggctgccgtcccctggggagcaggagctgagccggcgcttgcagcgcctgtatcccgcggtcaaccagcaagagactccgctgccgcgctcctggagccccaaggacaaatacaactacattggtctctcccagggcaacctccgcgtccactacaaaggtcatggcaaaaatcacaaagatgcggcctcagtgcgtgccacccaccccatacctgctgcctgtggcatttattactttgaagtgaagattgtcagcaaaggaagagatgggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaagtaaggtttattctactttcccctttcccttcctcacctgtccctaactctgctctctggctcatgtcaaccctggttaacctgtcaggagtccattcagctctggtcctcatgaccagcttgcagctcgaggccatgttcctgtcccaccttcaagatggcactgcccagatggacagttggcaggatggagacgtctcagggcagcctccctaatgcacattctgaaggctgggcgcaggccaggccctggcatggctggttccattcctccatttcctccctgcttgtttccttccccctgaatcctggattcctctcaacctcctgttcatggtcttccaggaaggctgtttgcctgccttagtagttctgcttattcctagcc

SEQ ID NO: 25431 - DNA, 2232 bp, Homo sapiens
gacacaatagtagctccctccaagatggcggcagcgacggcagacccgggagctgggaacccgcagcctggggactcctccggcgggggcgctgggggcgggctgccgtcccctggggagcaggagctgagccggcgcttgcagcgcctgtatcccgcggtcaaccagcaagagactccgctgccgcgctcctggagccccaaggacaaatacaactacattggtctctcccagggcaacctccgcgtccactacaaaggtcatggcaaaaatcacaaagatgcggcctcagtgcgtgccacccaccccatacctgctgcctgtggcatttattactttgaagtgaagattgtcagcaaaggaagagatggttacatgggaataggactctcggctcaaggcgtcaacatgaacagacttcctggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcaacccatggctacagcttgaaaggaggcccaaccaggctgctccaaccacaccccctgggccaactcccacctcaacccctccccacagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagttggtgatagcttattattttcataagt

SEQ ID NO: 25432 - DNA, 2756 bp, Homo sapiens
acaatagtagctccctccaagatggcggcagcgacggcagacccgggagctgggaacccgcagcctggggactcctccggcgggggcgctgggggcgggctgccgtcccctggggagcaggagctgagccggcgcttgcagcgcctgtatcccgcggtcaaccagcaagagactccgctgccgcgctcctggagccccaaggacaaatacaactacattggtctctcccagggcaacctccgcgtccactacaaaggtcatggcaaaaatcacaaagatgcggcctcagtgcgtgccacccaccccatacctgctgcctgtggcatttattactttgaagtgaagattgtcagcaaaggaagagatggttacatgggaataggactctcggctcaaggcgtcaacatgaacagacttcctgatcccacttccagaaacctgagttctttgctccaggtccaacagaggtgaacccacttgccccagactggggttattttcctgcaaaaaccggatcctcgtgtgttccccatctctgctgacagccactgtccaccttggcccccaggactaagtgtcattgaatccactcctgactcacatttggtcatatggggaaatagacatcaagggctgtggtcagctggtggagcagagcatggattctggagctataccacctgcatttgcatcctggcggctgtgttacctggacctgggacccatgttacagctgacagtccctgcagtgtccaccattaacaccacctctctctggagcatctttcaccttgggatctacagtacttcacaggggtctgctgtggggcagccaggtccctctgtgagggaagccatgcttcttccgagctgggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagttggtgatagcttattattttcat

SEQ ID NO: 25433 - DNA, 4588 bp, Homo sapiens
ctccagcgcttcgaatgcggacgcgaagcctggctgaggctgcgaaggacgagcggcgcagggaccccgcgggcgtctggggcttccgcggcgcccgcctctgctccctcccctcgggcgctgggtgccgaccggccggctggccggcgccgcctcctgggaagatggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagggtttgtctgatccaggtaattatcatgaattttgtcgatttttggctcgtttaaagacaaattatcagctgggagaattagttatggtgaaggaatatcctgaagttattagattgattgctaattttaccattactagcctacagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggacgtcttgcatggctggtatacttagttgggacagttgtaggaggaagattaacatataccagtacagatgagcatgatgctatggatggagaattatcctgtcgagtttttcagcttatatctttaatggataccggattgcctcgatgttgtaatgagaaaatagagcttgcaattctgtggttcttggatcagtttcgtaaaacatatgttggtgatcaacttcaaagaacctcaaaggtatatgctcgtatgtcagaagtcttaggaataacagatgacaaccacgttctagagacgttcatgacaaaaattgttacaaaccttaaatactggggaagatatgagcctgtaatttcaaggactcttcagttcctaaatgacctttctgttggttatatccttttaaaaaaacttgtgaagatagatgctgtgaaattcatgctaaaaaaccacacgagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcgagggattgcctttgcactgaacacaaagaccagctacaccatgctgtttgactggatgtacccaacgtaccttccccttcttcagaatgctgttgaacggtggtatggagagccaacatgtacaactcccatcttgaaacttatggcagaacttatgcaaaacagatcccagcgtttgaattttgatgtatcatctcctaatggaattcttctcttcagagaagctagtaaaatggtttgcacttatggtaatcagatcctgtcccttgggagcctctcaaaagatcagatttatccaatgaaactcaagggcatctccatctgctattcagctctcaagtctgccttgtgtggaaattatgtcagctttggcgtcttcaagttgtatggggacaaccattttgacaatgtactccaggcttttgtcaaaatgctgctgtcagtgtcccacagtgacttgctacaataccggaaactgagccagtcttattatccactcctggaatgtctcactcaggaccatatgagcttcatcatcaacttagagcctcctgtactcatgtatgttctcacatctatctcagagggactcactactcttgatacagttgtctcctccagctgctgtaccagtttagactacatcgtcacctacctcttcaagcacatagcaaaagagggcaagaagccacttcgatgcagagaggctacccaggctggtcagagactattacattttatgcagcaaaacccagatgtcctgcagcagatgatgtctgtcctcatgaacaccattgtctttgaagactgtcggaaccagtggtcagtatccaggcctctcctggggctcatcctgctcaatgagaagtatttcagtgaactgagagcaagtttgataaacagccagcccctccccaagcaggaggtccttgcccagtgcttcagaaacctaatggaaggagtggagcagaacctgtccgtcaagaacagagacaggttcacccaaaatctgtctgtattcagaagagatgtggcagaggcgttgcgcagtgatggcaacactgaaccatgcagtctcgacatgatgagctgacccgacttttctgaccatgtgcggagcagcctttatcaagagactcctgaaggtctgggtctcaggacagtgatgttggctagcccaggggaatgtatttttcaaaacatacaagcaacagcaaaagccctaacttcttatacgtctagcctaattataagaatttctaacagtaccagtgtaaattcagtcttttctctgaaaagcaaaggatgtgttttcagtctttctatcaaatattatctttgttctcctaatgctctgaaaggatgtagaaacaatatttaaccaaagaacgtaataaaccaggtttgcacctaagtgtgtactagtttatggttctgcagtcaaggttgtcaatttgttggagatgcagccttcaccatggatcctggattgagacgaatgccattggaacctgttaaatgagtagtttgttatgtgtctggaagaagcagcgttagggactttgggctgtgagcatttagaacgagcctggaagcactacagagcatcccacaggaccacacgcaggcctccctgcctcagctgcatctgataaagttgagagacagtaacacaattaaatgacttagaaacaatgtttgcttttcactggcataaatctgaagtggttcagtctagaagaattaagctgtgcaattactgcctgcagagatatttcttcaggaggagtcatgtagccccagtcagaagttctgggtggtgccagcacccagtcctctgcctccatttaatttttaagagaaggtgaaggtaactattagaatataatatttgaagcagctctgccttcttagggctacccaaaacagttctaggtgctaaaattcagattttcagaggatgagaaatagctggtttccaactctccacaaaaactcttattactgttgggacttgggattctgactcaccccaaacccagaacatgaagaagacctttacagtttgtgctctactgttactaggctattaatttgagatcgtccactgtcaagtgttttactatctcactgctgtttttatgattcaggcttataacaaatattgtatcctttatttctgataagacatgaaaggttggccttactgttgaacaataagtaaatccacaggctcctgttgtaatctca

SEQ ID NO: 25434 - DNA, 2078 bp, Homo sapiens
attgaataacatcatggaatcagaatacttgaactggaagagatcatataatatatagtctagtagtttttctgtttgctccgtggttggggcagggaggggaggaggaggagcttggcaagttatcttctccttccgtgaaacagagcactttaaagtgcttactttctttatcacttactttctcatattggccttccaggtatatgctcgtatgtcagaagtcttaggaataacagatgacaaccacgttctagagacgttcatgacaaaaattgttacaaaccttaaatactggggaagatatgagcctgtaatttcaaggactcttcagttcctaaatgacctttctgttggttatatccttttaaaaaaacttgtgaagatagatgctgtgaaattcatgctaaaaaaccacacgagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcgagggattgcctttgcactgaacacaaagaccagctacaccatgctgtttgactggatgtacccaacgtaccttccccttcttcagaatgctgttgaacggtggtatggagagccaacatgtacaactcccatcttgaaacttatggcagaacttatgcaaaacagatcccagcgtttgaattttgatgtatcatctcctaatggaattcttctcttcagagaagctagtaaaatggtttgcacttatggtaatcagatcctgtcccttgggagcctctcaaaagatcagatttatccaatgaaactcaagggcatctccatctgctattcagctctcaagtctgccttgtgtggaaattatgtcagctttggcgtcttcaagttgtatggggacaaccattttgacaatgtactccaggcttttgtcaaaatgctgctgtcagtgtcccacagtgacttgctacaataccggaaactgagccagtcttattatccactcctggaatgtctcactcaggaccatatgagcttcatcatcaacttagagcctcctgtactcatgtatgttctcacatctatctcagagggactcactactcttgatacagttgtctcctccagctgctgtaccagtttagactacatcgtcacctacctcttcaagcacatagcaaaagagggcaagaagccacttcgatgcagagaggctacccaggctggtcagagactattacattttatgcagcaaaacccagatgtcctgcagcagatgatgtctgtcctcatgaacaccattgtctttgaagactgtcggaaccagtggtcagtatccaggcctctcctggggctcatcctgctcaatgagaagtatttcagtgaactgagagcaagtttgataaacagccagcccctccccaagcaggaggtccttgcccagtgcttcagaaacctaatggaaggagtggagcagaacctgtccgtcaagaacagagacaggttcacccaaaatctgtctgtattcagaagagatgtggcagaggcgttgcgcagtgatggcaacactgaaccatgcagtctcgacatgatgagctgacccgacttttctgaccatgtgcggagcagcctttatcaagagactcctgaaggtctgggtctcaggacagtgatgttggctagcccaggggaatgtatttttcaaaacatacaagcaacagcaaaagccctaacttcttatacgtctagcctaattataagaatttctaacagtaccagtgtaaattcagtcttttctctgaaaagcaaaggatgtgttttcagtctttctatcaaatattatctttgttctcctaatgctctgaaaggatgtagaaacaatatttaaccaaagaacgtaataaaccaggtttgcacct

SEQ ID NO: 25435 - DNA, 1678 bp, Homo sapiens
gccgcctcctgggaagatggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccaggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagggtttgtctgatccaggtaattatcatgaattttgtcgatttttggctcgtttaaagacaaattatcagctgggagaattagttatggtgaaggaatatcctgaagttattagattgattgctaattttaccattactagcctacagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggacgtcttgcatggctggtatacttagttgggacagttgtaggaggaagattaacatataccagtacagatgagcatgatgctatggatggagaattatcctgtcgagtttttcagcttatatctttaatggataccggattgcctcgatgttgtaatgagaaaatagagcttgcaattctgtggttcttggatcagtttcgtaaaacatatgttggtgatcaacttcaaagaacctcaaagaagacgtttatttattta

SEQ ID NO: 25436 - DNA, 11711 bp, Homo sapiens
cacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcagtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaggactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctgatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtatttcaggtgtacttgtgtttatgtactcctgacgtattaaaatggaataatactaatcttgttaaaagcaatagacctcaaactattgaaggaatatgatatatgcaatttaattttaattccttttaagatatttggacttcctgcatggatatacttaccatttgaataaagggaccacaacttggataatttaattttaggtttgaaatatatttggtaatcttaactattggtgtactcatttatgcatagagactcgtttatgaatgggtagagccacagaacgtatagagttaaccaaagtgctcttctctagaatctttacacctcctgtgtggttacaagttaactttgtaagtagcgtaccttccttccttaaaatatctagcttcctgtgccctttcatagatattcgattaatttttacattttaaacaagttgactatttcctttaggggttttgtttcaaacttttctgtcatctgtctctactacctcagaaactgcagcttggttctgatgatagaaattgaatttttccttgtagttattgtgataaagtatgaatatttttagaaagtctataccatgttctttcgttaaagatttgctttatacaagattgttgcagtacctttttctggtaaattttgtagcagaaataaaatgacaattcctaagagccactgacatccaaaaaattcattacttacgcttcgggttcattctaaagtaaggaagacaatttaaaggcagtaaattcaaactgctgcataatttccagagctcctagtttctcaagtttgatacacaccaaaaacgtatttggaaatggcttgtatcaaatgttaggcaaattgctaaagaaaagaggatgttcttattggcctactcaatatggaactacaaagaatccaggtagaacacaaaattttgtatattgcaattatgaatattgactgtcttccacccatctgtgttctttcgggtgaaattacctcattttatttagtgaggaaagacaggtttattccctgttacatggggatttggaaattgggtatcctaaagcaagtaactgttcaaccaccagtcaaaagaggggagggatgttgtgcgagtaatgagtgatggtataccatcaccattccactcggccacaaagccagatacttgaaataaacctactccaaatgtatcagttcagtcttgaaccatggattacatatgtttacactaaatatttcaaattggcttatttggaaatctatgtaatataaactgatgtaaagtgtgttgtaacttttcagctgagacagttgatgccttcgtcatgattttagaataaattcttaagttaatgcaagtgctttttaagagactttttacagatttgtatgctttcctaaagcactaaagttacaaattaaaaagctttaaaaactttgaccaaaaatttgacaaaatgacatgtaaactgacttttcccgtattagtattccaaagatgcttaaaagtggcttgtggcatttatgagaaagtctttgtgtcacatttcaggaaaggactttgatttctctttgttatttaatcactgatgtggtctaaacccacgataatatgtatctttccttttaaactggattttatgttgtctcattaaaatctgcttaaagatagaataaaattcattatttgtaca

SEQ ID NO: 25437 - DNA, 3194 bp, Homo sapiens
agatggctcgtgcgcaggtgcgtgctaggagcgcggctcgtcagggcaggctgctctgcagggcaggcgatccggggctcgcctccgcgcggcattcagcgcgcaggcgcgagctggccgcctcacacggagtcggcttgttaagtgcgcacgcgcgggagtttctggcagaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaact

SEQ ID NO: 25438 - DNA, 1194 bp, Homo sapiens
gcagatgtgactaaagcagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctggtggcttctccgccacccacacccttcccaccctgctgtggggccctgcctttgtggggagcagccagccctctgcccctgcccagggctccccaactataggcctgggacccccgcccagcttggggggctgctcgtacgagtgtag

SEQ ID NO: 25439 - DNA, 3398 bp, Homo sapiens
agatggctcgtgcgcaggtgcgtgctaggagcgcggctcgtcagggcaggctgctctgcagggcaggcgatccggggctcgcctccgcgcggcattcagcgcgcaggcgcgagctggccgcctcacacggagtcggcttgttaagtgcgcacgcgcgggagtttctggcagaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaact

SEQ ID NO: 25440 - DNA, 3383 bp, Homo sapiens
agatggctcgtgcgcaggtgcgtgctaggagcgcggctcgtcagggcaggctgctctgcagggcaggcgatccggggctcgcctccgcgcggcattcagcgcgcaggcgcgagctggccgcctcacacggagtcggcttgttaagtgcgcacgcgcgggagtttctggcagaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaact

SEQ ID NO: 25441 - DNA, 1670 bp, Homo sapiens
agaaagcaggcgagcctgggccggcgcggggccttgtgggagggcttaaggaagtaaaatggcggacctggcgaacgaagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactg

SEQ ID NO: 25442 - DNA, 3113 bp, Homo sapiens
gaagcagaggaggaaggagagaagaggtggaggtggccgcaggctgagtcgcggccgggatgtccgggcagccgccgccgccgccgccgcagcagcagcaacagcagcagcagctgtcgccgccaccgccggcggccttggccccagtctccggagtcgtcctgccggcgcccccggccgtcagcgccggctcttctccggccggctcgcccggcggcggtgcgggcggcgaaggcttaggggccgcggcggccgccctgctcctccaccctccgccgccgccgcccccggccaccgcggccccgccgcccccgccgccgcccccgcctccccctgcctcagcggctgcccccgccagcgggccgcccgctcccccgggccttgcagcgggccccggcccggctggaggagccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtcatggcaaaaccccaaaagatgccgcgtcagttcgagccacgcatccaataccagcagcctgtgggatttattattttgaagtaaaaattgtcagtaagggaagagatggttacatgggaattggtctttctgctcaaggtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtattgctttcactgacctaccgccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaaaatggtttcatcttatttagtccaccatgggtactgtgccacagcagaggcctttgccagatctacagaccagaccgttctagaagaattagcttccattaagaatagacaaagaattcagaaattggtattagcaggaagaatgggagaagccattgaaacaacacaacagttatacccaagtttacttgaaagaaatcctaatctccttttcacattaaaagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccagtaatgatgtagacatggaaacagatcactactccaatggagttggagaaacttcatccaatggtttcctaaatggtagctctaaacatgaccacgaaatggaagattgtgacaccgaaatggaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggatgcattcagtctactagcatattcagatccctggaacagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccccactcccatataagcattcaatcagtgtaacttgcaaaatgcataaacatccgacagtttgaatttatagtgttgatggaagaaatcatttttaatgtgtactgtaaaacttgaaatactcaggagctgagtgaatatgtttgttgctacttacaatcccgacctgttagtcccagtagttttgttttaacatggtctttttcaactttgtttcctgtttaactacagatgacttctgttgtagactcacaagtttaactgttgtattataacagtattacatgtcaacggtgtggttatgacctttatttatataaaaaccaaatatttagtcaatttaccgtgtcttaatttaatctttgtacaccttccatttttaagtgcttaaatgagtactatattgcaataaaatgtagtgatataattaaccagccattaaaaatttacttctacaga

SEQ ID NO: 25443 - DNA, 1392 bp, Homo sapiens
ccaacgttctctcccggcctcccgggcccgccgcctactcccgcgtctccgagctcctcaaccgccgcggtctccctgggcgcgcggcccgccgcctgcttccggggcgggcggactgggcgcctggtgccggcggccgcagcgacagcgcccccgggaagcagaggaggaaggagagaagaggtggaggtggccgcaggctgagtcgcggccgggatgtccgggcagccgccgccgccgccgccgcagcagcagcaacagcagcagcagctgtcgccgccaccgccggcggccttggccccagtctccggagtcgtcctgccggcgcccccggccgtcagcgccggctcttctccggccggctcgcccggcggcggtgcgggcggcgaaggcttaggggccgcggcggccgccctgctcctccaccctccgccgccgccgcccccggccaccgcggccccgccgcccccgccgccgcccccgcctccccctgcctcagcggctgcccccgccagcgggccgcccgctcccccgggccttgcagcgggccccggcccggctggaggagccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtcatggcaaaaccccaaaagatgccgcgtcagttcgagccacgcatccaataccagcagcctgtgggatttattattttgaagtaaaaattgtcagtaagggaagagatggttacatgggaattggtctttctgctcaaggtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtattgctttcactgacctaccgcctttagattatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacgaatgtaccagaactaaacagtataaatatgtcaagatcacagcaagttaa

SEQ ID NO: 25444 - DNA, 1640 bp, Homo sapiens
agaagccaaggaagtcagttcaaaggaggactgctaagtctccactggtttgtcatttggggggttaattagtccttgtgatagcagtttccttaaaattggggtgatagcaggtgcagtgtgtcaaagagagttacatgggaattggtctttctgctcaaggtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtattgctttcactgacctaccgccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaaaatggtttcatcttatttagtccaccatgggtactgtgccacagcagaggcctttgccagatctacagaccagaccgttctagaagaattagcttccattaagaatagacaaagaattcagaaattggtattagcaggaagaatgggagaagccattgaaacaacacaacagttatacccaagtttacttgaaagaaatcctaatctccttttcacattaaaagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccagtaatgatgtagacatggaaacagatcactactccaatggagttggagaaacttcatccaatggtttcctaaatggtagctctaaacatgaccacgaaatggaagattgtgacaccgaaatggaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggatgcattcagtctactagcatattcagatccctggaacagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattag

SEQ ID NO: 25445 - DNA, 993 bp, Homo sapiens
gcttccgccatctttccagcctcagtcggacgggcgcggagacgcttctggaagcttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttaga

SEQ ID NO: 25446 - DNA, 780 bp, Homo sapiens
agtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagagatggggattcaccatgttgcccatgctggtctggaactcatgagctcagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagtttt

SEQ ID NO: 25447 - DNA, 1530 bp, Homo sapiens
tgcgcttccgccatctttccagcctcagtcggacgggcgcggagacgcttctggaaggtatcgcgacccggcgggcccggcacggccgggcggggacaggggtggcggcggcgggataggggtcggagccggggccagggccggggcgggtggcggacccaggggcagcgggcggctgagtaggtgggtggtgcgggcccggccgggccggggcaggagacgggcgtggggtcggcgctagcccccgcgaacccccgtttcatcctccgctctcatccccgtcccggtcccagtcccgttcccatccctacacctccggccgccgttccccgggccccgccgccccggatgccggccccgcccgccgccttcccgctcccaggcctggccgccatggcgccgcgggcgggaggcctttgtggggcgggcacgtggggcgctgggggcgcgggagcggggccgccatgggctgcggggccgcgcgagcgctcgcctccgtcctctgcctccgcaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaa

SEQ ID NO: 25448 - DNA, 2455 bp, Homo sapiens
cgccggcgtcggctgcgtctccggcgtttgaattgcgcttccgccatctttccagcctcagtcggacgggcgcggagacgcttctggaagcttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctg

SEQ ID NO: 25449 - DNA, 1475 bp, Homo sapiens
gaattgcgcttccgccatctttccagcctcagtcggacgggcgcggagacgcttctggaagcttgtattggttggtgatggtggtactggaaaaacgaccttcgtgaaacgtcatttgactggtgaatttgagaagaaccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggtt

SEQ ID NO: 25450 - DNA, 2661 bp, Homo sapiens
accgcgcctcccgccccaccctaagcgcagcgaccgcccgagcggccgaccgaaccgcgttgcgtgcgtgcgcgcacgcgcgggccacgtgggcgggcgccgcgccgttgccccgccccttgcaaccccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 25451 - DNA, 5498 bp, Homo sapiens
ctggtttcacgcgtctcgggagccaggttggcggtgcgatgaggcgcagcaaggcctacggggagcggtacctcgcctcggtgcagggctccgccccgtcgcctggaaagaagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttg

SEQ ID NO: 25452 - DNA, 6692 bp, Homo sapiens
atttgtgacttgtctcatgaacgtgatgggttttaacacagaccgcttagcatggactagaaataagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtttgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagt

SEQ ID NO: 25453 - DNA, 2453 bp, Homo sapiens
tatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcat

SEQ ID NO: 25454 - DNA, 6697 bp, Homo sapiens
atttgtgacttgtctcatgaacgtgatgggttttaacacagaccgcttagcatggactagaaataagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtttgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaa

SEQ ID NO: 25455 - DNA, 5498 bp, Homo sapiens
ctggtttcacgcgtctcgggagccaggttggcggtgcgatgaggcgcagcaaagcctacggggagcggtacctcgcctcggtgcagggctccgccccgtcgcctggaaagaagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttg

SEQ ID NO: 25456 - DNA, 6931 bp, Homo sapiens
caagacaccctcagagcacagggtgctgccaagagcccggccgagtgcagctcgagcgccgacgtcgccaaggatacacagtgctgacgcagtacacaagtgcgtcacagtggtcctccgccggctacgtcagtggctttcaggcgctttcctgttggaattggcgactgctgcggggctgagcgctggtttcacgcgtctcgggagccaggttggcggtgcgatgaggcgcagcaaagcctacggggagcggtacctcgcctcggtgcagggctccgccccgtcgcctggaaagaagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtctgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttaatgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaa

SEQ ID NO: 25457 - DNA, 6695 bp, Homo sapiens
atttgtgacttgtctcatgaacgtgatgggttttaacacagaccgcttagcatggactagaaataagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtctgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttaatgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagt

SEQ ID NO: 25458 - DNA, 2453 bp, Homo sapiens
tatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcat

SEQ ID NO: 25459 - DNA, 5383 bp, Homo sapiens
aggcgctttcctcttggaattggcgactgctgcggggctgagcgctggtctcacgcatctcgggagccaggttggtggcgcgatgagttgcagcaaggcctacggggagcggtacgtcgcctcggtgcagggctccgccccgtcgcctcgaaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcagaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaactcagcaaaattgagacttctagttcagcatgaaataaacactctaagagcccaggaaaaacatggccttcaacctgctctgcttgtacattgggcaaaatgccttcagaaaatgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggaggtcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagtgaaaagcctcttgaaaatgatactggcttacaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaagtcagtggaaagaaaggggcttggggaacttaaaaattctcaaaaacgaggtcaatggcaaagtaagaatgctgatgcaaagagaacaagtactaaaagtgtgtgctaatcattggataacgactacaatgaacctgaagcccctctctggatcagatagagcatggatgtggtcagccagtgatttctctgatggtgatgccaaactagagcgattggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcgctgaggaagaaaataagggttcaggtacaggtgcggccggtgcctcagacacaacaataaaacccaatgctgaaaacactgggcccacattagaatgggataactatgatttaagggaagatgctttggatgatagtgtcagtagtagctcagtacatgcttctccattggcaagtagccctgtgagaaaaaatcttttccactttgatgagtcaacaacaggatctaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaattctacagatatgataaagatgttggtcaatggaaagaaaggggcattggtgatataaagattttacagaattatgataataagcacgttcgtatactgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggtatgctgaatttactaaagaagaattggttcagaagctcagttccaccacaaaaagtgcagatcacttaaacggcctgcttcgggaaatagaggcaaccaatgcagtccttatggagcaaattaagcttctcaaaagtgaaataagaagattggaaaggaatcaagagcaagaggtgtctgcagctaacgtggaacacttgaagaacgtcttgctgcagttcattttcttgaagccaggtagtgaaagagagagacttcttcctgttataaatacgatgttgcagctcagccttgaagaaaagggaaaacttgctgcggttgctcaagctgaacgtggttttgttttaaattctactttttaa

SEQ ID NO: 25460 - DNA, 736 bp, Homo sapiens
tagttctcgggggcttgggcacccgggtgctgtatcggcgggtttcttcccatctcctggacatttactttatatgctgcggcggaggtcatacctccttggcctggaggaacccagtggggactgacgcagctccgggtgagctttggcggctgcgtcgagtgacaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcagaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaagttt

SEQ ID NO: 25461 - DNA, 3599 bp, Homo sapiens
attcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaactcagcaaaattgagacttctagttcagcatgaaataaacactctaagagcccaggaaaaacatggccttcaacctgctctgcttgtacattgggcaaaatgccttcagaaaatgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggaggtcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagtgaaaagcctcttgaaaatgatactggcttacaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaagtcagtggaaagaaaggggcttggggaacttaaaaattctcaaaaacgaggtcaatggcaaagtaagaatgctgatgcaaagagaacaagtactaaaagtgtgtgctaatcattggataacgactacaatgaacctgaagcccctctctggatcagatagagcatggatgtggtcagccagtgatttctctgatggtgatgccaaactagagcgattggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggtatgctgaatttactaaagaagaattggttcagaagctcagttccaccacaaaaagtgcagatcacttaaacggcctgcttcgggaaatagaggcaaccaatgcagtccttatggagcaaattaagcttctcaaaagtgaaataagaagattggaaaggaatcaagagcaagaggtgtctgcagctaacgtggaacacttgaagaacgtcttgctgcagttcattttcttgaagccaggtagtgaaagagagagacttcttcctgttataaatacgatgttgcagctcagccttgaagaaaagggaaaacttgctgcggttgctcaaggtgaggaataaaatgcttcccgttcttctggatgggcatcctatcttcgtagttggtttggacttcgataggttgatggaaggaatgtttttattaaccaaataaaatctatttac

SEQ ID NO: 25462 - DNA, 1136 bp, Homo sapiens
gtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggtatgctgaatttactaaagaagaattggttcagaagctcagttccaccacaaaaagtgcagatcacttaaacggcctgcttcgggaaatagaggcaaccaatgcagtccttatggagcaaattaagcttctcaaaagtgaaataagaagattggaaaggaatcaagagcaagaggtgtctgcagctaacgtggaacacttgaagaacgtcttgctgcagttcattttcttgaagccaggtagtgaaagagagagacttcttcctgttataaatacgatgttgcagctcagccttgaagaaaagggaaaacttgctgcggttgctcaaggtcttcaagaaacctccatacccaagaaaaaatagaaagcaacgatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagcataacaacgattacatagcatttacattatattagggattgcacaagagaaggtatgtaggttatatgcaaatactgcaccattttacataagggacttgagaagcatggattttggtag

SEQ ID NO: 25463 - DNA, 5594 bp, Homo sapiens
gctttcaggcgctttcctcttggaattggcgactgctgcggggctgagcgctggtctcacgcatctcgggagccaggttggtggcgcgatgagttgcagcaaggcctacggggagcggtacgtcgcctcggtgcagggctccgccccgtcgcctcgaaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcagaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaactcagcaaaattgagacttctagttcagcatgaaataaacactctaagagcccaggaaaaacatggccttcaacctgctctgcttgtacattgggcaaaatgccttcagaaaatgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggaggtcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagtgaaaagcctcttgaaaatgatactggcttacaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaagtcagtggaaagaaaggggcttggggaacttaaaaattctcaaaaacgaggtcaatggcaaagtaagaatgctgatgcaaagagaacaagtactaaaagtgtgtgctaatcattggataacgactacaatgaacctgaagcccctctctggatcagatagagcatggatgtggtcagccagtgatttctctgatggtgatgccaaactagagcgattggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcgctgaggaagaaaataagggttcaggtacaggtgcggccggtgcctcagacacaacaataaaacccaatgctgaaaacactgggcccacattagaatgggataactatgatttaagggaagatgctttggatgatagtgtcagtagtagctcagtacatgcttctccattggcaagtagccctgtgagaaaaaatcttttccactttgatgagtcaacaacaggatctaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaattctacagatatgataaagatgttggtcaatggaaagaaaggggcattggtgatataaagattttacagaattatgataataagcacgttcgtatactgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggtatgctgaatttactaaagaagaattggttcagaagctcagttccaccacaaaaagtgcagatcacttaaacggcctgcttcgggaaatagaggcaaccaatgcagtccttatggagcaaattaagcttctcaaaagtgaaataagaagattggaaaggaatcaagagcaagaggtgtctgcagctaacgtggaacacttgaagaacgtcttgctgcagttcattttcttgaagccaggtagtgaaagagagagacttcttcctgttataaatacgatgttgcagctcagccttgaagaaaagggaaaacttgctgcggttgctcaaggtgaggaataaaatgcttcccgttcttctggatgggcatcctatcttcgtagttggtttggacttcgataggttgatggaaggaatgtttttattaaccaaataaaatctatttacaaaaatggttcatgtgtattaccatcattcttttgtcaaaaagtgtgtatatgtttgcatttacatatatttgtacatctatatgacagatgtattttaaaagtttcaacttgaagtaaaagta

SEQ ID NO: 25464 - DNA, 5383 bp, Homo sapiens
aggcgctttcctgttggaattggcgactgctgcggggctgagcgctggtttcacgcgtctcgggagccaggttggtggcgcgatgagttgcagcaaggcctacggggagcggtacgtcgcctccgtgcagggctccgccccgtcgcctcgaaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatctggtgttgaagattgcagaattgctttgtaaaaatgatgttactgatggaagagcaaaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtatgtaaacagctttgtacagaaagacaaaaatcttggtgggatgcggtttgtactctgattcacagaaaagcagtacctggaaactcagcaaaattgagacttttagttcagcatgaaataaacactctaagagcccaggaaaaacatggccttcaacctgctctgcttgtacattgggcaaaatgccttcagaaaatgggcagtggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggagatcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaaggaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctataagactgaggacagcgatgacatccattttgaaccagtagttcaaatgcctgaaaaagtagaacttgtaataggagaagaaggtgaaaaagttctgtattcacagggggtaaaactatttagatttgatgctgaggtaaggcagtggaaagaaaggggcttggggaacttaaaaattctcaaaaacgaggtcaatggcaaaccaagaatgctgatgcgaagagaacaagtactaaaagtgtgtgctaatcattggataacgactacaatgaacctgaagcccctgtctggatcagatagagcatggatgtggtcagccagtgatttctctgatggtgatgccaaactagagcggttagcagcaaaatttaaaacaccagagctggctgaagaattcaagcagaaatttgaggaatgccagcagcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactgtgatttaagggaagatgctttggatgatagtgtcagtagtagctcagtacatgcttctccattggcaagtagccctgtgagaaaaaatcttttccattttggtgagtcaacaacaggatctaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaaaaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacacaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcatctttgaaaagtaacaacagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcacttaaacggcctgcttcgggaagcagaggcaaccagtgcagtccttatggagcaaattaagcttctcaaaagtgaaataagaagattggaaaggaatcaagagcaagaggagtctgcagctaacgtggaacacttgaagaacgtcttgctgcagttcattttcttgaagccaggtagtgaaagagagagacttcttcctgttataaatacgatgttgcagctcagccctgaagaaaagggaaaacttgctgcggttgctcaagctgaacgtggttttgttttaaattctactttttaa

SEQ ID NO: 25465 - DNA, 3599 bp, Homo sapiens
attcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtatgtaaacagctttgtacagaaagacaaaaatcttggtgggatgcggtttgtactctgattcacagaaaagcagtacctggaaactcagcaaaattgagacttttagttcagcatgaaataaacactctaagagcccaggaaaaacatggccttcaacctgctctgcttgtacattgggcaaaatgccttcagaaaatgggcagtggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggagatcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaaggaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctataagactgaggacagcgatgacatccattttgaaccagtagttcaaatgcctgaaaaagtagaacttgtaataggagaagaaggtgaaaaagttctgtattcacagggggtaaaactatttagatttgatgctgaggtaaggcagtggaaagaaaggggcttggggaacttaaaaattctcaaaaacgaggtcaatggcaaaccaagaatgctgatgcgaagagaacaagtactaaaagtgtgtgctaatcattggataacgactacaatgaacctgaagcccctgtctggatcagatagagcatggatgtggtcagccagtgatttctctgatggtgatgccaaactagagcggttagcagcaaaatttaaaacaccagagctggctgaagaattcaagcagaaatttgaggaatgccagcagcttctgttagacataccacttcaaactccccataaacttgtagatactggcagagctgccaagttaatacagagagctgaagaaatgaagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcacttaaacggcctgcttcgggaagcagaggcaaccagtgcagtccttatggagcaaattaagcttctcaaaagtgaaataagaagattggaaaggaatcaagagcaagaggagtctgcagctaacgtggaacacttgaagaacgtcttgctgcagttcattttcttgaagccaggtagtgaaagagagagacttcttcctgttataaatacgatgttgcagctcagccctgaagaaaagggaaaacttgctgcggttgctcaaggtgaggaataaaatgcttcccgttcttctggatgggcatcctatcttcgtagttggtttggacttcgataggttgatggaaggaatatttttattaaccaaataaaatctatttac

SEQ ID NO: 25466 - DNA, 736 bp, Homo sapiens
tggttctcgggggcttaggcacccgggtgctgtatcggcgggtttcttcccatctcctggacatttactttatatgctgcggcggaggtcgtacctccttggcctggaggaacccagtggggactgacgcagctccgggtgagctttggcggctgcgtcgagtgacaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatctggtgttgaagattgcagaattgctttgtaaaaatgatgttactgatggaagagcaaaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaagttt

SEQ ID NO: 25467 - DNA, 5464 bp, Homo sapiens
ctttcctgttggaattggcgactgctgcggggctgagcgctggtttcacgcgtctcgggagccaggttggtggcgcgatgagttgcagcaaggcctacggggagcggtacgtcgcctccgtgcagggctccgccccgtcgcctcgaaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatctggtgttgaagattgcagaattgctttgtaaaaatgatgttactgatggaagagcaaaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtatgtaaacagctttgtacagaaagacaaaaatcttggtgggatgcggtttgtactctgattcacagaaaagcagtacctggaaactcagcaaaattgagacttttagttcagcatgaaataaacactctaagagcccaggaaaaacatggccttcaacctgctctgcttgtacattgggcaaaatgccttcagaaaatgggcagtggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggagatcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaaggaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctataagactgaggacagcgatgacatccattttgaaccagtagttcaaatgcctgaaaaagtagaacttgtaataggagaagaaggtgaaaaagttctgtattcacagggggtaaaactatttagatttgatgctgaggtaaggcagtggaaagaaaggggcttggggaacttaaaaattctcaaaaacgaggtcaatggcaaaccaagaatgctgatgcgaagagaacaagtactaaaagtgtgtgctaatcattggataacgactacaatgaacctgaagcccctgtctggatcagatagagcatggatgtggtcagccagtgatttctctgatggtgatgccaaactagagcggttagcagcaaaatttaaaacaccagagctggctgaagaattcaagcagaaatttgaggaatgccagcagcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactgtgatttaagggaagatgctttggatgatagtgtcagtagtagctcagtacatgcttctccattggcaagtagccctgtgagaaaaaatcttttccattttggtgagtcaacaacaggatctaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaaaaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacacaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcatctttgaaaagtaacaacagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcacttaaacggcctgcttcgggaagcagaggcaaccagtgcagtccttatggagcaaattaagcttctcaaaagtgaaataagaagattggaaaggaatcaagagcaagaggagtctgcagctaacgtggaacacttgaagaacgtcttgctgcagttcattttcttgaagccaggtagtgaaagagagagacttcttcctgttataaatacgatgttgcagctcagccctgaagaaaagggaaaacttgctgcggttgctcaaggtgaggaataaaatgcttcccgttcttctggatgggcatcctatcttcgtagttggtttggacttcgataggttgatggaaggaatatttttattaaccaaataaaatctatttacaaaaa

SEQ ID NO: 25468 - DNA, 7253 bp, Homo sapiens
gtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctatattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgtatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaaccaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatatttttatggctgc

SEQ ID NO: 25469 - DNA, 2907 bp, Homo sapiens
acacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagaagcagcacatcgtcattttacaattgagaaacatggagactccaaatggattatttacaggttcacaaaacagctttgtggcactgaaagggcgagagccaagatctcctga

SEQ ID NO: 25470 - DNA, 541 bp, Homo sapiens
gaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattg

SEQ ID NO: 25471 - DNA, 3304 bp, Homo sapiens
ataaaccccagggctcattcttgagctgctcctgcatagatctcgtcctgttcaacacaccaaagattgacagctgaactgagagaccatcacccacagacacaactggccactgggtggtgcacaagtcagacagaactgaatagtcctgtgaagactctggacactgaactgactttggaaccagactgcagaatggaggggtgggaacttgtggcttgaacctaatcaggtttcattaaggttttctatagataagatcatgtcaagacaccctcagaccacagggcggcgccacgagcccggccgagtgcagctggagcgccgacgtcgccgaggatacacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagaagcagcacatcgtcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatcaa

SEQ ID NO: 25472 - DNA, 7165 bp, Homo sapiens
ctttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctatattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgtatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaaccaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 25473 - DNA, 2848 bp, Homo sapiens
ctttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagaagcagcacatcgtcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatcaa

SEQ ID NO: 25474 - DNA, 5576 bp, Homo sapiens
acacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttacaggctcaggatattaggggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgatggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaatcacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatccttcccgttcttctggatgagcatcctatcttcgtagttggtttggacttcgataggttgatggaaggaatacttctattaaccaaatagaatctgtttacaaaaa

SEQ ID NO: 25475 - DNA, 2511 bp, Homo sapiens
gcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaa

SEQ ID NO: 25476 - DNA, 2774 bp, Homo sapiens
cgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaa
